United States Patent
Schellenberger et al.

(10) Patent No.: US 9,849,188 B2
(45) Date of Patent: *Dec. 26, 2017

(54) GROWTH HORMONE POLYPEPTIDES AND METHODS OF MAKING AND USING SAME

(71) Applicant: Amunix Operating Inc., Mountain View, CA (US)

(72) Inventors: Volker Schellenberger, Palo Alto, CA (US); Joshua Silverman, Sunnyvale, CA (US); Willem P. Stemmer, Los Gatos, CA (US); Chia-wei Wang, Milpitas, CA (US); Nathan Geething, Santa Clara, CA (US); Jeffrey L. Cleland, San Carlos, CA (US); Benjamin Spink, San Carlos, CA (US)

(73) Assignee: Amunix Operating Inc., Mountain View, CA (US)

(*) Notice: Subject to any disclaimer, the term of this patent is extended or adjusted under 35 U.S.C. 154(b) by 0 days.

This patent is subject to a terminal disclaimer.

(21) Appl. No.: 14/843,143

(22) Filed: Sep. 2, 2015

(65) Prior Publication Data
US 2017/0095567 A1    Apr. 6, 2017

Related U.S. Application Data

(63) Continuation of application No. 14/152,692, filed on Jan. 10, 2014, now Pat. No. 9,168,312, which is a
(Continued)

(51) Int. Cl.
  *C07K 14/00* (2006.01)
  *C07K 14/61* (2006.01)
  *A61K 47/48* (2006.01)

(52) U.S. Cl.
  CPC ...... *A61K 47/48246* (2013.01); *C07K 14/001* (2013.01); *C07K 14/61* (2013.01); *C07K 2319/00* (2013.01)

(58) Field of Classification Search
  CPC ............ C07K 14/61; C07K 2319/31; C07K 2319/00; C07K 2319/35; C07K 14/001;
  (Continued)

(56) References Cited

U.S. PATENT DOCUMENTS 4,898,830 A   2/1990   Goeddel et al.
5,089,473 A   2/1992   Krivi et al.
(Continued)

FOREIGN PATENT DOCUMENTS

EP    0556171 B1    8/2000
JP    2000502901 A  3/2000
(Continued)

OTHER PUBLICATIONS

Alam, et al. Expression and purification of a mutant human growth hormone that is resistant to proteolytic cleavage by thrombin, plasmin and human plasma in vitro. J Biotechnol. 1998; 65(2-3):183-90.
(Continued)

*Primary Examiner* — Randall L Beane
(74) *Attorney, Agent, or Firm* — Wilson Sonsini Goodrich & Rosati

(57) ABSTRACT

The present invention relates to compositions comprising growth hormone linked to extended recombinant polypeptide (XTEN), isolated nucleic acids encoding the compositions and vectors and host cells containing the same, and methods of making and using such compositions in treatment of growth hormone-related diseases, disorders, and conditions.

24 Claims, 38 Drawing Sheets

Related U.S. Application Data continuation of application No. 12/796,640, filed on Jun. 8, 2010, now Pat. No. 8,703,717, which is a continuation of application No. 12/699,761, filed on Feb. 3, 2010, now Pat. No. 8,673,860, and a continuation of application No. PCT/US2010/023106, filed on Feb. 3, 2010.

(60) Provisional application No. 61/185,112, filed on Jun. 8, 2009, provisional application No. 61/236,836, filed on Aug. 25, 2009, provisional application No. 61/280,955, filed on Nov. 10, 2009.

(58) Field of Classification Search
CPC ... A61K 47/48246; A61K 38/00; A61K 38/27
See application file for complete search history.

(56) References Cited

U.S. PATENT DOCUMENTS

| | | |
|---|---|---|
| 5,141,922 A | 8/1992 | Krivi |
| 5,270,176 A | 12/1993 | Doerschug et al. |
| 5,364,934 A | 11/1994 | Drayna et al. |
| 5,399,489 A | 3/1995 | Krivi |
| 5,424,199 A | 6/1995 | Goeddel et al. |
| 5,554,730 A | 9/1996 | Woiszwillo et al. |
| 5,599,907 A | 2/1997 | Anderson et al. |
| 6,406,632 B1 | 6/2002 | Safir et al. |
| 6,500,448 B1 | 12/2002 | Johnson et al. |
| 6,692,941 B1 | 2/2004 | Miller et al. |
| 6,828,305 B2 | 12/2004 | Ekwuribe et al. |
| 6,905,688 B2 | 6/2005 | Rosen et al. |
| 7,045,318 B2 | 5/2006 | Ballance |
| 7,294,513 B2 | 11/2007 | Wyatt |
| 7,442,778 B2 | 10/2008 | Gegg et al. |
| 7,452,967 B2 | 11/2008 | Bertin |
| 7,528,242 B2 | 5/2009 | Anderson et al. |
| 7,709,605 B2 | 5/2010 | Knopf et al. |
| 8,129,348 B2 | 3/2012 | Besman et al. |
| 8,178,495 B2 | 5/2012 | Chilkoti |
| 8,673,860 B2 | 3/2014 | Schellenberger et al. |
| 8,680,050 B2 | 3/2014 | Schellenberger et al. |
| 8,703,717 B2 | 4/2014 | Schellenberger et al. |
| 9,168,312 B2 | 10/2015 | Schellenberger et al. |
| 9,371,369 B2 | 6/2016 | Schellenberger et al. |
| 2003/0049689 A1 | 3/2003 | Edwards et al. |
| 2003/0181381 A1 | 9/2003 | Himmelspach et al. |
| 2003/0190740 A1 | 10/2003 | Altman |
| 2004/0043446 A1 | 3/2004 | DeFrees et al. |
| 2004/0127417 A1 | 7/2004 | Finn |
| 2004/0142870 A1 | 7/2004 | Finn |
| 2004/0259775 A1 | 12/2004 | Kyle |
| 2004/0259780 A1 | 12/2004 | Glasebrook et al. |
| 2005/0042721 A1 | 2/2005 | Fang et al. |
| 2005/0118136 A1 | 6/2005 | Leung et al. |
| 2005/0123997 A1 | 6/2005 | Lollar |
| 2005/0287153 A1 | 12/2005 | Dennis |
| 2006/0026719 A1 | 2/2006 | Kieliszewski et al. |
| 2006/0287220 A1 | 12/2006 | Li et al. |
| 2006/0293232 A1 | 12/2006 | Levy et al. |
| 2007/0048282 A1 | 3/2007 | Rosen et al. |
| 2007/0161087 A1 | 7/2007 | Glaesner et al. |
| 2007/0203058 A1 | 8/2007 | Lau et al. |
| 2007/0244301 A1 | 10/2007 | Siekmann et al. |
| 2008/0039341 A1 | 2/2008 | Schellenberger et al. |
| 2008/0167238 A1 | 7/2008 | Rosen et al. |
| 2008/0176288 A1 | 7/2008 | Leung et al. |
| 2008/0234193 A1 | 9/2008 | Bossard et al. |
| 2008/0260755 A1 | 10/2008 | Metzner et al. |
| 2008/0261877 A1 | 10/2008 | Ballance et al. |
| 2008/0269125 A1 | 10/2008 | Ballance et al. |
| 2008/0286808 A1 | 11/2008 | Schellenberger et al. |
| 2008/0312157 A1 | 12/2008 | Levy et al. |
| 2009/0042787 A1 | 2/2009 | Metzner et al. |
| 2009/0060862 A1 | 3/2009 | Chang et al. |
| 2009/0092582 A1 | 4/2009 | Bogin et al. |
| 2010/0189682 A1 | 7/2010 | Schellenberger et al. |
| 2010/0239554 A1 | 9/2010 | Schellenberger et al. |
| 2010/0292130 A1 | 11/2010 | Skerra et al. |
| 2011/0077199 A1 | 3/2011 | Schellenberger et al. |
| 2011/0151433 A1 | 6/2011 | Schellenberger et al. |
| 2011/0172146 A1 | 7/2011 | Schellenberger et al. |
| 2012/0116056 A1 | 5/2012 | Sun et al. |
| 2014/0162949 A1 | 6/2014 | Cleland et al. |
| 2016/0158321 A1 | 6/2016 | Cleland et al. |
| 2016/0280753 A1 | 9/2016 | Schellenberger et al. |
| 2017/0037088 A1 | 2/2017 | Schellenberger et al. |

FOREIGN PATENT DOCUMENTS

| | | |
|---|---|---|
| RU | 2005133665 A | 6/2006 |
| WO | WO-9711178 A1 | 3/1997 |
| WO | WO-9733552 A1 | 9/1997 |
| WO | WO-9949901 A1 | 10/1999 |
| WO | WO-02077036 A2 | 10/2002 |
| WO | WO-2005025499 A2 | 3/2005 |
| WO | WO-2005025499 A3 | 5/2005 |
| WO | WO-2005069845 A2 | 8/2005 |
| WO | WO-2005079838 A1 | 9/2005 |
| WO | WO-2006024953 A2 | 3/2006 |
| WO | WO-2006081249 A2 | 8/2006 |
| WO | WO-2006081249 A3 | 2/2007 |
| WO | WO-2007073486 A2 | 6/2007 |
| WO | WO-2007090584 A1 | 8/2007 |
| WO | WO-2007103455 A2 | 9/2007 |
| WO | WO-2007103515 A2 | 9/2007 |
| WO | WO-2007103455 A3 | 11/2007 |
| WO | WO-2008027854 A2 | 3/2008 |
| WO | WO-2008049931 A1 | 5/2008 |
| WO | WO-2008077616 A1 | 7/2008 |
| WO | WO-2008155134 A1 | 12/2008 |
| WO | WO-2009023270 A2 | 2/2009 |
| WO | WO-2010091122 A1 | 8/2010 |
| WO | WO-2010144502 A2 | 12/2010 |
| WO | WO-2010144508 A1 | 12/2010 |
| WO | WO-2011026815 A1 | 3/2011 |
| WO | WO-2011028228 A1 | 3/2011 |
| WO | WO-2011028229 A1 | 3/2011 |
| WO | WO-2011084808 A2 | 7/2011 |
| WO | WO-2011087808 A1 | 7/2011 |
| WO | WO-2011087810 A1 | 7/2011 |
| WO | WO-2011123813 A2 | 10/2011 |
| WO | WO-2011123830 A2 | 10/2011 |
| WO | WO-2013184216 A1 | 12/2013 |

OTHER PUBLICATIONS

Altschul et al., Basic local alignment search tool. J Mol Biol. Oct. 5, 1990;215(3):403-10.

Alvarez, et al. Improving Protein Pharmacokinetics by Genetic Fusion to Simple Amino Acid Sequences. J Biol Chem. 2004; 279: 3375-81.

Arndt, et al. Factors influencing the dimer to monomer transition of an antibody single-chain Fv fragment. Biochemistry. 1998; 37(37):12918-26.

Ausubel, et al. eds. Current Protocols in Molecular Biology. Wiley. 1987.

Bailon, et al. Rational design of a potent, long-lasting form of interferon: a 40 kDa branched polyethylene glycol-conjugated interferon alpha-2a for the treatment of hepatitis C. Bioconjug Chem. Mar.-Apr. 2001;12(2):195-202.

Buscaglia, et al. Tandem amino acid repeats from Trypanosoma cruzi shed antigens increase the half-life of proteins in blood. Blood. Mar. 15, 1999;93(6):2025-32.

Chou, et al. Prediction of Protein Conformation. Biochemistry. 1974; 13: 222-245.

Chou; et al., "Prediction of the Secondary Structure of Proteins from Their Amino Acid Sequence, from Advances in Enzymology vol. 47, John Wiley and Sons. Published 1978, p. 60."

Clark, et al. Long-acting growth hormones produced by conjugation with polyethylene glycol. J Biol Chem. 1996; 271(36):21969-77.

(56) References Cited

OTHER PUBLICATIONS

Clark, et al. Recombinant human growth hormone (GH)-binding protein enhances the growth-promoting activity of human GH in the rat. Endocrinology. 1996; 137(10):4308-15.

Cleland, et al. A novel human growth hormone XTEN construct (VRS-317) for monthly administration. Endocrine Journal, vol. 57, No. Suppl. 2, Mar. 2010 (Mar. 2010), p. S618, XP002696184, & 14th International Congress of Endocrinology ICE2010; Kyoto, Japan; Mar. 26-30, 2010 ISSN: 0918-8959 (abstract).

Cleland, et al. A novel long-acting human growth hormone fusion protein (VRS-317): enhanced in vivo potency and half-life. J Pharm Sci. Aug. 2012;101(8):2744-54. doi: 10.1002/jps.23229. Epub Jun. 7, 2012.

Collen, et al. Polyethylene Glycol-Derivatized Cysteine-Substitution Variants of Recombinant Staphylokinase for Single-Bolus Treatment of Acute Myocardial Infarction. Circulation. 2000; 102: 1766-72.

Co-pending U.S. Appl. No. 14/771,445, filed Aug. 28, 2015.

D'Aquino, et al. The magnitude of the backbone conformational entropy change in protein folding. Proteins. 1996; 25: 143-56.

Dattani, et al. An investigation into the lability of the bioactivity of human growth hormone using the ESTA bioassay. Horm Res. 1996; 46(2):64-73.

Deckert, et al. Pharmacokinetics and microdistribution of polyethylene glycol-modified humanized A33 antibody targeting colon cancer xenografts. Int J Cancer. 2000; 87: 382-90.

Dhalluin, et al. Structural and biophysical characterization of the 40 kDa PEG-interferon-alpha2a and its individual positional isomers. Bioconjug Chem. 2005; 16: 504-17.

Ellis, et al. Valid and invalid implementations of GOR secondary structure predictions. Comput Appl Biosci. Jun. 1994;10(3):341-8.

Etherton, et al. Biology of somatotropin in growth and lactation of domestic animals. Physiol Rev. Jul. 1998;78(3):745-61.

European search report and search opinion dated May 14, 2013 for EP Application No. 10786725.

European search report dated Jan. 27, 2011 for Application No. 08795371.7.

Geething, et al. Gcg-XTEN: an improved glucagon capable of preventing hypoglycemia without increasing baseline blood glucose. PLoS One. Apr. 14, 2010;5(4):e10175. doi: 10.1371/journal.pone.0010175.

Greenwald, et al. Effective drug delivery by PEGylated drug conjugates. Adv Drug Deliv Rev. 2003; 55: 217-50.

Gustafsson, et al. Codon bias and heterologous protein expression. Trends Biotechnol. Jul. 2004;22(7):346-53.

Harris, et al. Effect of pegylation on pharmaceuticals. Nat Rev Drug Discov. 2003; 2: 214-21.

Hinds, et al. PEGylated insulin in PLGA microparticles. In vivo and in vitro analysis. J Control Release. Jun. 2, 2005;104(3):447-60.

Hopp, et al. Prediction of protein antigenic determinants from amino acid sequences. Proc Natl Acad Sci U S A 1981; 78, 3824-3828, #3232.

International search report and written opinion dated Dec. 20, 2010 for PCT Application No. US10/02147.

International search report dated Mar. 14, 2012 for PCT Application No. US2011/48517.

International search report dated Jul. 12, 2011 for PCT Application No. US10/61590.

International search report dated Oct. 29, 2010 for PCT Application No. US10/37855.

International search report dated Dec. 26, 2007 for PCT Application No. US2007/05952.

International search report dated Mar. 16, 2009 for PCT Application No. US2008/09787.

International search report dated Apr. 20, 2010 for PCT Application No. US10/23106.

Kangueane; et al., "T-Epitope Designer: A HLA-peptide binding prediction server.", May 15, 2005, 1(1), 21-4.

Khan, et al. Solubilization of recombinant ovine growth hormone with retention of native-like secondary structure and its refolding from the inclusion bodies of *Escherichia coli*. Biotechnol Prog. 1998; 14(5):722-8.

Kochendoerfer. Chemical and biological properties of polymer-modified proteins. Expert Opin Biol Ther. 2003; 3: 1253-61.

Kohn, et al. Random-coil behavior and the dimensions of chemically unfolded proteins. Proc Natl Acad Sci U S A. Aug. 24, 2004;101(34):12491-6.

Kornblatt, et al. Cross-linking of cytochrome oxidase subunits with difluorodinitrobenzene. Can J. Biochem. 1980; 58: 219-224.

Kubetzko, et al. Protein PEGylation decreases observed target association rates via a dual blocking mechanism. Mol Pharmacol. 2005; 68: 1439-54.

Kyngas, et al. Unreliability of the Chou-Fasman parameters in predicting protein secondary structure. Protein Eng. May 1998;11(5):345-8.

Lee, et al. Stabilizing peptide fusion for solving the stability and solubility problems of therapeutic proteins. Pharm Res. Oct. 2005;22(10):1735-46. Epub Sep. 22, 2005.

Levitt, M. A simplified representation of protein conformations for rapid simulation of protein folding. J Mol Biol. Jun. 14, 1976;104(1):59-107.

Liu et al. The Human beta-Defensin-1 and alpha-Defensins Are Encoded by Adjacent Genes: Two Peptide Families with Differing Disulfide Topology Share a Common Ancestry. Genomics. 1997; 43:316-320.

McPherson, et al. eds. PCR 2: a practical approach. Oxford University Press. 1995.

Mitraki, et al. Protein Folding Intermediates and Inclusion Body Formation. Bio/Technology. 1989; 7:690-697.

Office action dated Apr. 29, 2013 for U.S. Appl. No. 12/939,129.

Office action dated Jun. 6, 2012 for U.S. Appl. No. 12/939,129.

Office action dated Aug. 23, 2012 for U.S. Appl. No. 12/848,984.

Oslo, ed. Remington's Pharmaceutical Sciences. 16th edition. 1980.

Patra, et al. Optimization of inclusion body solubilization and renaturation of recombinant human growth hormone from *Escherichia coli*. Protein Expr Purif. 2000; 18(2):182-92.

Pepinsky, et al. Improved pharmacokinetic properties of a polyethylene glycol-modified form of interferon-beta-1a with preserved in vitro bioactivity. J Pharmacol Exp Ther. 2001; 297: 1059-66.

Sambrook, et al. Molecular Cloning: A Laboratory Manual, 2nd Edition; Current Protocols in Molecular Biology. 1989.

Schellenberger, et al. A recombinant polypeptide extends the in vivo half-life of peptides and proteins in a tunable manner. Nat Biotechnol. Dec. 2009;27(12):1186-90.

Schlapschy, et al. Fusion of a recombinant antibody fragment with a homo-amino-acid polymer: effects on biophysical properties and prolonged plasma half-life. Protein Eng Des Sel. Jun. 2007;20(6):273-84. Epub Jun. 26, 2007.

Singh, et al. ProPred: Prediction of HLA-DR binding sites. Bioinformatics. 2001; 17: 1236-1237.

Smith, et al. Single-step purification of polypeptides expressed in *Escherichia coli* as fusions with glutathione S-transferase. Gene. 1988; 67(1):31-40.

Stickler, et al. Human population-based identification of CD4(+) T-cell peptide epitope determinants. J Immunol Methods. 2003; 281: 95-108.

Stites, et al. Empirical evaluation of the influence of side chains on the conformational entropy of the polypeptide backbone. Proteins. 1995; 22: 132-140.

Sturniolo, et al. Generation of tissue-specific and promiscuous HLA ligand databases using DNA microarrays and virtual HLA class II matrices. Natural Biotechnol. 1999; 17: 555-561.

Uversky, et al. Why are "natively unfolded" proteins unstructured under physiologic conditions? Proteins. Nov. 15, 2000;41(3):415-27.

Venkatachalam, et al. Conformation of polypeptide chains. Annu Rev Biochem. 1969; 38: 45-82.

Voet; et al., "Biochemistry (3rd Ed.). John Wiley and Sons. Published 2004, p. 230."

Walker, et al. Using protein-based motifs to stabilize peptides. J Pept Res. Nov. 2003;62(5):214-26.

(56) References Cited

OTHER PUBLICATIONS

Wright, et al. Intrinsically unstructured proteins: re-assessing the protein structure-function paradigm. J Mol Biol. Oct. 22, 1999;293(2):321-31.
Yang, et al. Tailoring structure-function and pharmacokinetic properties of single-chain Fv proteins by site-specific PEGylation. Protein Eng. 2003; 16: 761-70.
Yankai, et al. Ten tandem repeats of beta-hCG 109-118 enhance immunogenicity and anti-tumor effects of beta-hCG C-terminal peptide carried by mycobacterial heat-shock protein HSP65. Biochem Biophys Res Commun. 2006; 345(4):1365-71.
Bidlingmaier, et al. Comparative pharmacokinetics and pharmacodynamics of a new sustained-release growth hormone (GH), LB03002, versus daily GH in adults with GH deficiency. J Clin Endocrinol Metab. Aug. 2006;91(8):2926-30. Epub May 23, 2006.
Biller, et al. Effects of once-weekly sustained-release growth hormone: a double-blind, placebo-controlled study in adult growth hormone deficiency. J Clin Endocrinol Metab. Jun. 2011;96(6):1718-26. doi: 10.1210/jc.2010-2819. Epub Mar. 16, 2011.
Chang, et al. High-level secretion of human growth hormone by *Escherichia coli*. Gene. 1987;55(2-3):189-96.
Cook, et al. The pharmacokinetic and pharmacodynamic characteristics of a long-acting growth hormone (GH) preparation (nutropin depot) in GH-deficient adults. J Clin Endocrinol Metab. Oct. 2002;87(10):4508-14.
Cuneo, et al. The Australian Multicenter Trial of Growth Hormone (GH) Treatment in GH-Deficient Adults. J Clin Endocrinol Metab. Jan. 1998;83(1):107-16.
DeSchepper, et al. Long-acting pegylated human GH in children with GH deficiency: a single-dose, dose-escalation trial investigating safety, tolerability, pharmacokinetics and pharmacodynamics. Eur J Endocrinol. Sep. 2011;165(3):401-9. doi: 10.1530/EJE-11-0536. Epub Jul. 1, 2011.
Desrosiers, et al. Patient outcomes in the GHMonitor: the effect of delivery device on compliance and growth. Pediatr Endocrinol Rev. Feb. 2005;2 Suppl 3:327-31.
Fares, et al. Designing a long-acting human growth hormone (hGH) by fusing the carboxyl-terminal peptide of human chorionic gonadotropin beta-subunit to the coding sequence of hGH. Endocrinology. Sep. 2010;151(9):4410-7. doi: 10.1210/en.2009-1431. Epub Jul. 21, 2010.
George, et al. An analysis of protein domain linkers: their classification and role in protein folding. Protein Eng. Nov. 2002;15(11):871-9.
Goeddel, et al. Direct expression in *Escherichia coli* of a DNA sequence coding for human growth hormone. Nature. Oct. 18, 1979;281(5732):544-8.
Gray, et al. Periplasmic production of correctly processed human growth hormone in *Escherichia coli*: natural and bacterial signal sequences are interchangeable. Gene. 1985;39(2-3):247-54.
International searh report and written opinion dated Jul. 7, 2014 for PCT Application No. PCT/US2014/022850.
Jorgensen, et al. Pulsatile versus continuous intravenous administration of growth hormone (GH) in GH-deficient patients: effects on circulating insulin-like growth factor-I and metabolic indices. J Clin Endocrinol Metab. Jun. 1990;70(6):1616-23.
Laursen, et al. Continuous infusion versus daily injections of growth hormone (GH) for 4 weeks in GH-deficient patients. J Clin Endocrinol Metab. Aug. 1995;80(8):2410-8.
Le Roith, et al. The somatomedin hypothesis: 2001. Endocr Rev. Feb. 2001;22(1):53-74.
Molitch, et al. Evaluation and treatment of adult growth hormone deficiency: an Endocrine Society clinical practice guideline. J Clin Endocrinol Metab. Jun. 2011;96(6):1587-609. doi: 10.1210/jc.2011-0179.
Peter, et al. Three-year efficacy and safety of LB03002, a once-weekly sustained-release growth hormone (GH) preparation, in prepubertal children with GH deficiency (GHD). J Clin Endocrinol Metab. Feb. 2012;97(2):400-7. doi: 10.1210/jc.2011-2234. Epub Dec. 7, 2011.
Rosenfeld, et al. Compliance and persistence in pediatric and adult patients receiving growth hormone therapy. Endocr Pract. Mar. 2008;14(2):143-54.
Sondergaard, et al. Pegylated long-acting human growth hormone possesses a promising once-weekly treatment profile, and multiple dosing is well tolerated in adult patients with growth hormone deficiency. J Clin Endocrinol Metab. Mar. 2011;96(3):681-8. doi: 10.1210/jc.2010-1931. Epub Dec. 22, 2010.
Svensson, et al. Both low and high serum IGF-I levels associate with cancer mortality in older men. J Clin Endocrinol Metab. Dec. 2012;97(12):4623-30. doi: 10.1210/jc.2012-2329. Epub Sep. 26, 2012.
Tauber, et al. Differential regulation of serum growth hormone (GH)-binding protein during continuous infusion versus daily injection of recombinant human GH in GH-deficient children. J Clin Endocrinol Metab. May 1993;76(5):1135-9.
Vance, et al. Growth hormone therapy in adults and children. N Engl J Med. Oct. 14, 1999;341(16):1206-16.
Yuen; et al., "A long-acting human growth hormone with delayed clearance (VRS-317): results of a double-blind, placebo-controlled, single ascending dose study in growth hormone-deficient adults. J Clin Endocrinol Metab. Jun. 2013;98(6):2595-603. doi: 10.1210/jc.2013-1437. Epub Apr. 12, 2013."
"Schellenberger et al. "Online Supplementary material: A recombinant polypeptide extends the in vivo half-life of peptides and proteins in a tunable manner", Nature biotechnology, vol. 27, No. 12, Nov. 15, 2009 (Nov. 15, 2009), pp. 1186-1190, XP055190665, ISSN: 1087-0156, DOI: 10.1038/nb.1588".
Cleland, et al. A Monthly Dosed GLP-1 Analog for Treatment of Type 2 Diabetes Mellitus. Diabetes, 2010; 59(1):A104. 70th Annual Meeting of the American Diabetes Association, Orland, FL, USA 2010.
Cleland, et al. An extended half-life exenatide construct for weekly administration in the treatment of diabetes mellitus. In Diabetes, vol. 58, pp. A511-A512. 1701 N Beauregard St, Alexandria, VA 22311-1717 USA: Amer Diabetes Assoc, 2009. Abstract only.
Bidlingmaier; et al., "Comparative pharmacokinetics and pharmacodynamics of a new sustained-release growth hormone (GH), LB03002, versus daily GH in adults with GH deficiency. J Clin Endocrinol Metab. Aug. 2006;91(8):2926-30. Epub May 23, 2006."
Biller; et al., "Effects of once-weekly sustained-release growth hormone: a double-blind, placebo-controlled study in adult growth hormone deficiency. J Clin Endocrinol Metab. Jun. 2011;96(6):1718-26. doi: 10.1210/jc.2010-2819. Epub Mar. 16, 2011."
Chou, et al. Conformational parameters for amino acids in helical, β-sheet, and random coil regions calculated from proteins. Biochemistry 13.2 (1974): 211-222.
Chou, et al. Empirical predictions of protein conformation. Annual review of biochemistry 47.1 (1978): 251-276.
Chou, et al. Prediction of the secondary structure of proteins from their amino acid sequence. Adv Enzymol Relat Areas Mol Biol. 1978;47:45-148.
Chou-Fasman values for random 200mer sequences composed of the amino acids GADSTEP; Reply to notice of opposition dated Apr. 8, 2016 for EP2402754.
Cleland; et al., "A novel human growth hormone XTEN construct (VRS-317) for monthly administration. Endocrine Journal, vol. 57, No. Suppl. 2, Mar. 2010 (Mar. 2010), p. S618, XP002696184, & 14th International Congress of Endocrinology ICE2010; Kyoto, Japan; Mar. 26-30, 2010 ISSN: 0918-8959 (abstract)."
Cleland, et al. A novel human growth hormone XTEN construct (VRS-317) for once-a-month subcutaneous administration. Growth Hormone & IGF Research 20 (2010): S5.
Clinicaltrials.gov archive. VRS-317 in Adult Subjects With Growth Hormone Deficiency. Updated May 23, 2011.
Composition and properties of some URPs according to the invention; Reply to notice of opposition dated Apr. 8, 2016 for EP2402754.

(56) References Cited

OTHER PUBLICATIONS

Cook; et al., "American Association of Clinical Endocrinologists Medical Guidelines for Clinical Practice for Growth Hormone Use in Growth Hormone-Deficient Adults and Transition Patients—2009 Update". Endocr Pract. Sep.-Oct. 2009;15 Suppl 2:1-29.
Cook; et al., "The pharmacokinetic and pharmacodynamic characteristics of a long-acting growth hormone (GH) preparation (nutropin depot) in GH-deficient adults. J Clin Endocrinol Metab. Oct. 2002;87(10):4508-14."
Co-pending U.S. Appl. No. 14/843,143, filed Sep. 2, 2015.
Co-pending U.S. Appl. No. 15/154,223, filed May 13, 2016.
Corrected version of "Exhibit 1" (D23) without cut and paste error; Reply to notice of opposition dated Apr. 8, 2016 for EP2402754.
Deschepper; et al., "Long-acting pegylated human GH in children with GH deficiency: a single-dose, dose-escalation trial investigating safety, tolerability, pharmacokinetics and pharmacodynamics. Eur J Endocrinol. Sep. 2011;165(3):401-9. doi: 10.1530/EJE-11-0536. Epub Jul. 1, 2011."
European search report dated Dec. 7, 2016 for EP Application No. EP14780175.7.
Fares; et al., "Designing a long-acting human growth hormone (hGH) by fusing the carboxyl-terminal peptide of human chorionic gonadotropin beta-subunit to the coding sequence of hGH. Endocrinology. Sep. 2010;151(9):4410-7. doi: 10.1210/en.2009-1431. Epub Jul. 21, 2010."
International search report and written opinion dated Jun. 6, 2013 for PCT Application No. US2013/031673.
Jorgensen; et al., "Pulsatile versus continuous intravenous administration of growth hormone (GH) in GH-deficient patients: effects on circulating insulin-like growth factor-I and metabolic indices.", Jun. 1990, 70(6), 1616-23.
Laursen; et al., "Continuous infusion versus daily injections of growth hormone (GH) for 4 weeks in GH-deficient patients. J Clin Endocrinol Metab. Aug. 1995;80(8):2410-8."
Laursen; et al., "Long-term effects of continuous subcutaneous infusion versus daily subcutaneous injections of growth hormone (GH) on the insulin-like growth factor system, insulin sensitivity, body composition, and bone and lipoprotein metabolism in GH-deficient adults. J Clin Endocrinol Metab. Mar. 2001;86(3):1222-8."
News-medical, SYNCO bio partners extend the collaboration with Versartis, Jul. 30, 2010, News-Medical.net, 3 pg, available at https://translate.googleusercontent.com/translate_c?depth=1 &h1=en&prev=search&rurl=translate.google.com&s1=ja &u=http://ww w. news-medical. net/news/20100730/86/Japanese. aspx&usg=ALkJ rh ioe ly-i2Q4w_NzzJ2cM IZcbcvSvA.
Office action dated Jun. 3, 2015 for U.S. Appl. No. 13/829,369.
Office action dated Aug. 9, 2016 for U.S. Appl. No. 13/829,369.
Office action dated Sep. 30, 2014 for U.S. Appl. No. 13/829,369.
Peter; et al., "Three-year efficacy and safety of LB03002, a once-weekly sustained-release growth hormone (GH) preparation, in prepubertal children with GH deficiency (GHD). J Clin Endocrinol Metab. Feb. 2012;97(2):400-7. doi: 10.1210/jc.2011-2234. Epub Dec. 7, 2011."
Presentation at International Symposium on IGF-1, GH, and Ghrelin/GHS 2011: Climbing the Scientific Growth Ladder, University of Southern Florida, Mar. 4-6, 2011, Orlando, FL, 125 total pages, (online Apr. 15, 2011), (slides internally Nos. 2, 9, 20, 33, 36, 49, 51-52, 55, 57-58, 64-66, 71, 83, and 86 missing in original),.
Sondergaard; et al., "Pegylated long-acting human growth hormone possesses a promising once-weekly treatment profile, and multiple dosing is well tolerated in adult patients with growth hormone deficiency. J Clin Endocrinol Metab. Mar. 2011;96(3):681-8. doi: 10.1210/jc.2010-1931. Epub Dec. 22, 2010."
Tauber; et al., "Differential regulation of serum growth hormone (GH)-binding protein during continuous infusion versus daily injection of recombinant human GH in GH-deficient children. J Clin Endocrinol Metab. May 1993;76(5):1135-9."
Tepitope values for random 200mer sequences composed of the amino acids GADSTEP; Reply to notice of opposition dated Apr. 8, 2016 for EP2402754.
Unpublished U.S. Appl. No. 14/077,068, filed Nov. 11, 2013.
Versartis Press Release, Versartis CEO Presents Positive Preclinical Data on Long-Acting Growth Hormone at International Congress of the GRS and IGF Society, 2 pages, Versartis, Oct. 4, 2010.
Yuen; et al., "A long-acting human growth hormone with delayed clearance (VRS-317): results of a double-blind, placebo-controlled, single ascending dose study in growth hormone-deficient adults.", Jun. 2013, 98(6), 2595-2603.

FIG. 3C
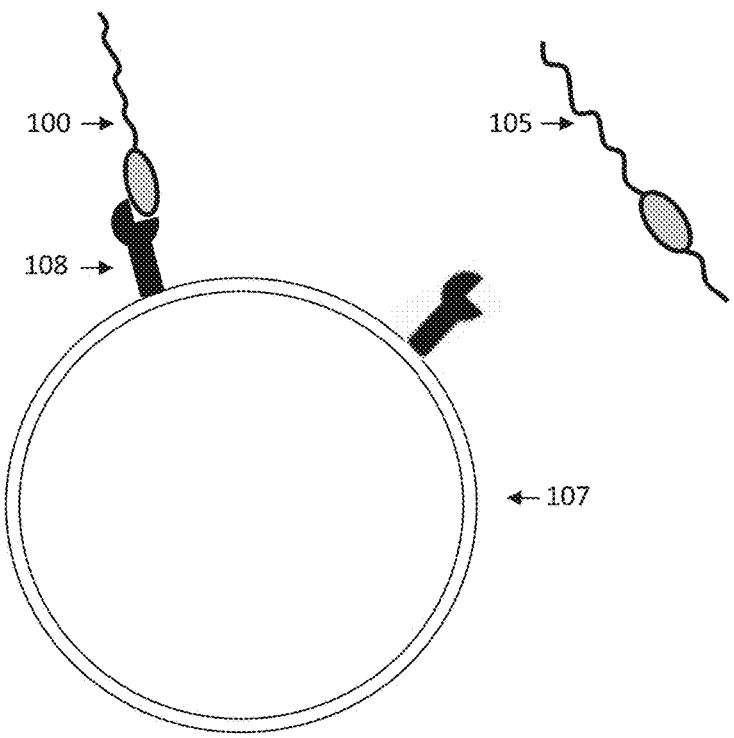
FIG. 3D
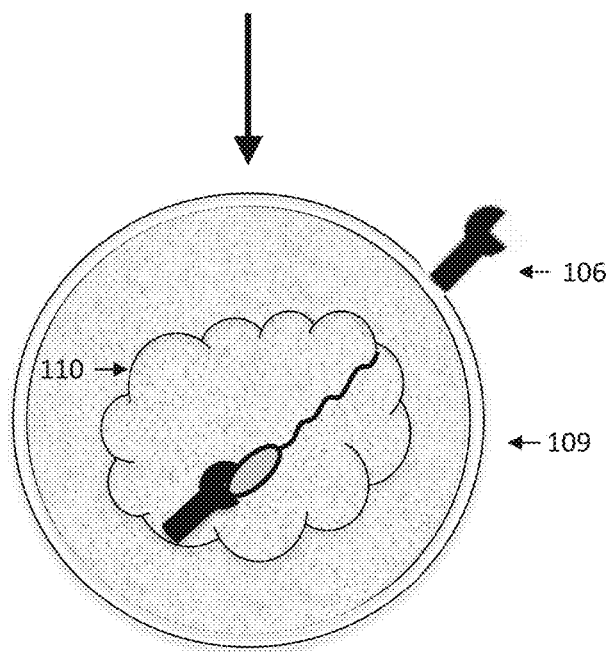
FIG. 3

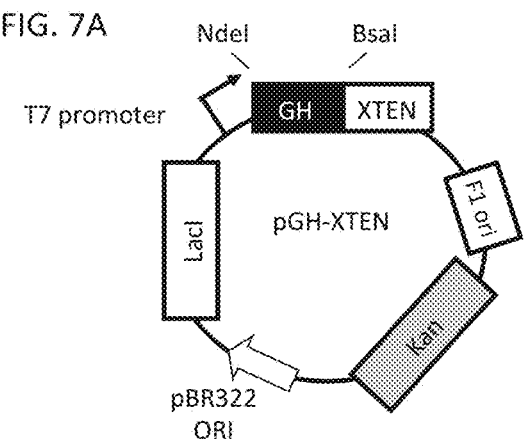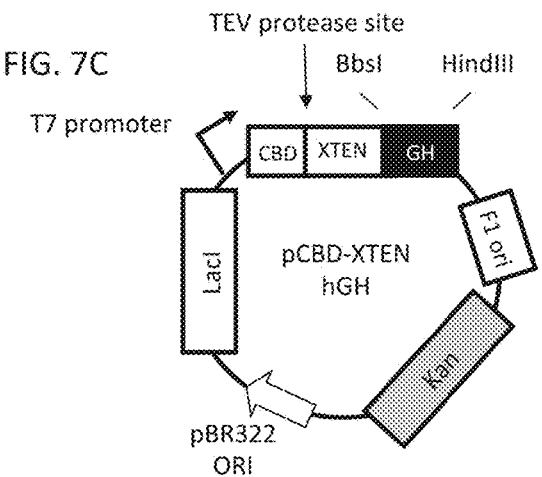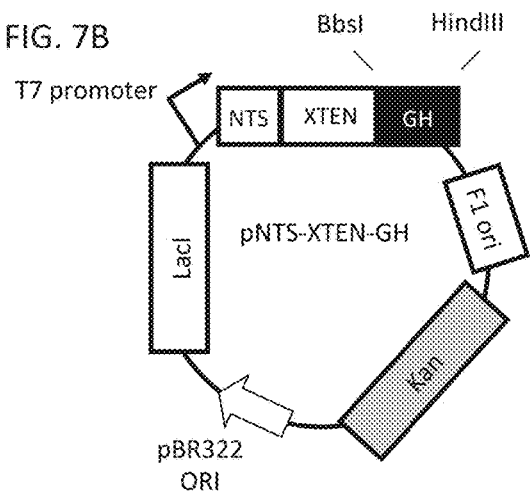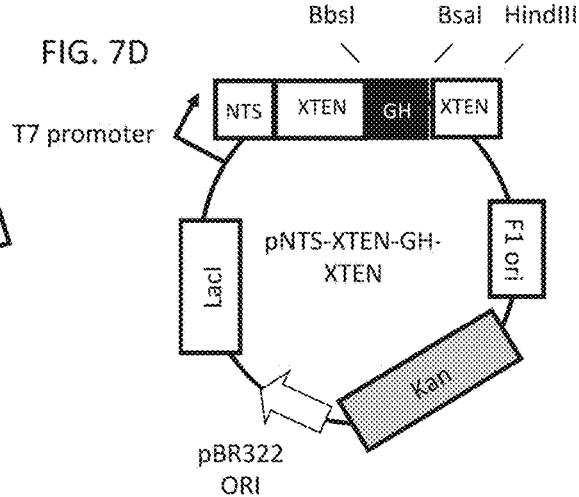
FIG. 7

```
LCW0569   ATGGCTNNNNNNNNGCTGGCTCTCCAACCTCCACTGAGGAAGGT
          M   A   X   X   A   G   S   P   T   S   T   E   E
LCW0570   ATGGCTNNNNNNNNGAAAGCGCAACCCCTGAGTCCGGTCCAGGT
          M   A   X   X   E   S   A   T   P   E   S   G   P
LCW0571   ATGGCTNNNNNNNNACTCCGTCTGGTGCTACCGGTTCCCCAGGT
          M   A   X   X   T   P   S   G   A   T   G   S   P
```

| X = | APST, | GS | or | GE |
|---|---|---|---|---|
| | TCAG/C/TCAG, | AG/G/TC | or | G/AG/AG |
| Diversity: | 16 | 4 | | 4 |

- Batch 2 libraries are based on 3 best clones from batch 1 screening.
- All 24 codons for 6 amino acids G,E,S,P,A,T are included.
- Each new library is composed of 3x3=9 pairs of annealed oligos.

FIG. 10

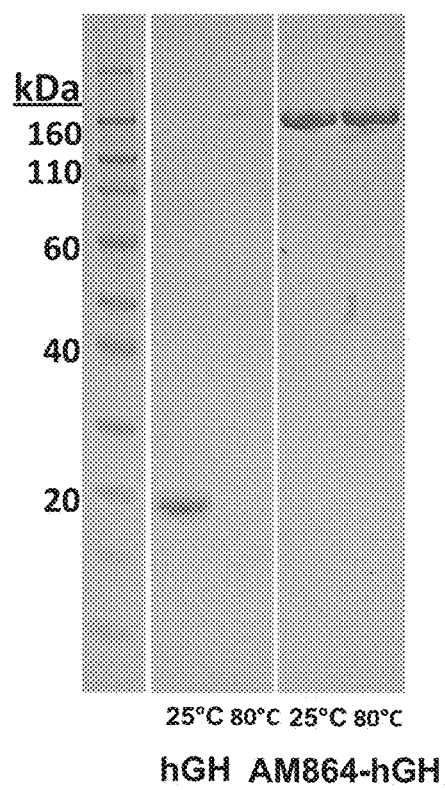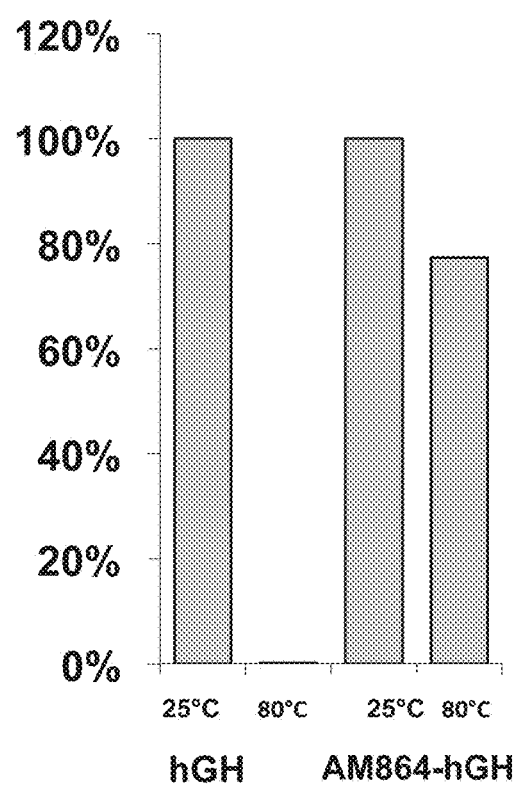
FIG. 17

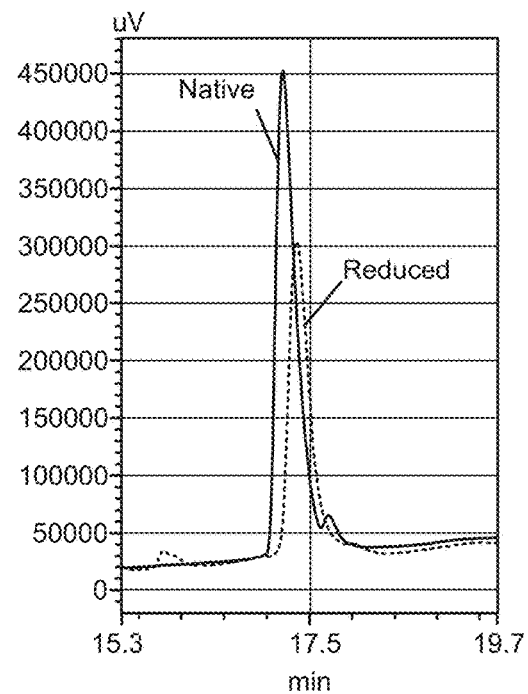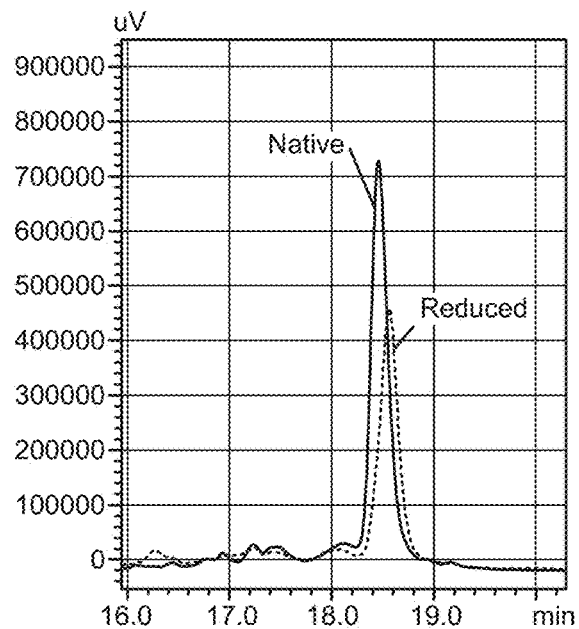
FIG. 21

A.
B.
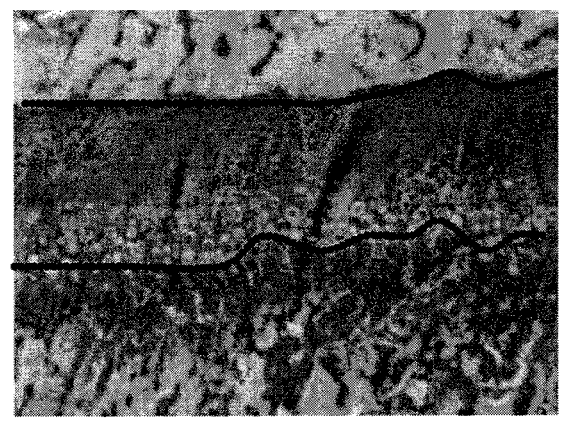
C.
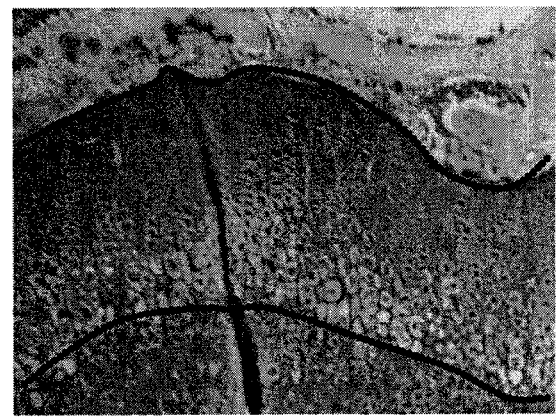
FIG. 26

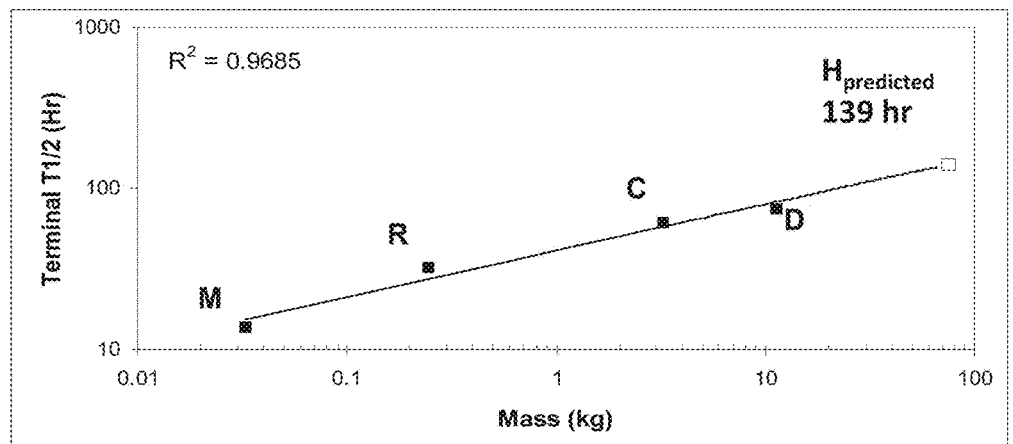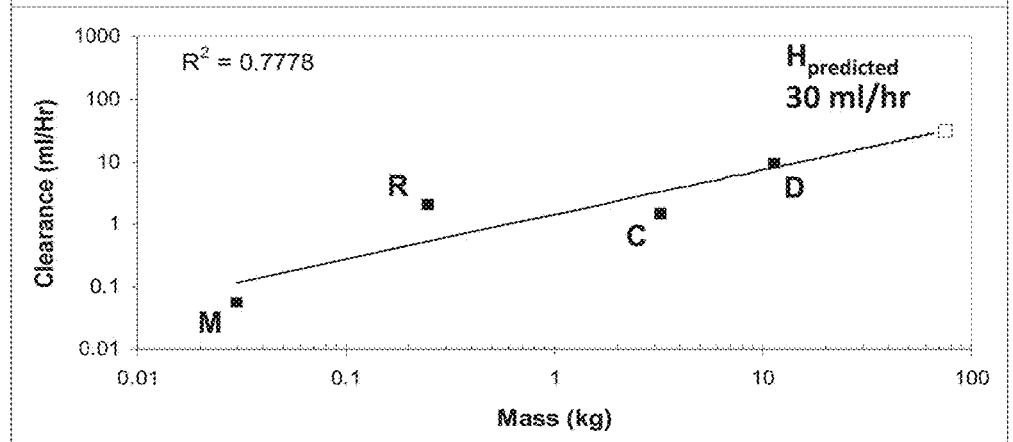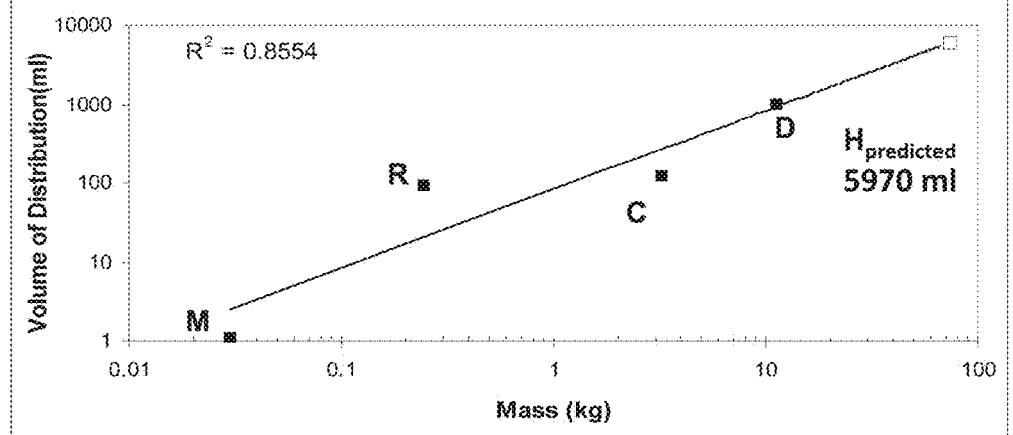
FIG. 36

GROWTH HORMONE POLYPEPTIDES AND METHODS OF MAKING AND USING SAME

CROSS-REFERENCE TO RELATED APPLICATIONS

This application is a Continuation Application which claims the priority benefit of U.S. application Ser. No. 14/152,692, filed Jan. 10, 2014, now U.S. Pat. No. 9,168,312, which is a Continuation Application which claims the priority benefit of U.S. application Ser. No. 12/796,640, filed Jun. 8, 2010, now U.S. Pat. No. 8,703,717; which claim the benefit of U.S. Provisional Application Ser. No. 61/185,112, filed Jun. 8, 2009; 61/236,836, filed Aug. 25, 2009; and 61/280,955, filed Nov. 10, 2009, and U.S. application Ser. No. 12/699,761, filed Feb. 3, 2010, now U.S. Pat. No. 8,673,860, and PCT Application Serial No. PCT/US10/23106, both filed Feb. 3, 2010 which are hereby incorporated herein by reference in their entirety.

SEQUENCE LISTING

The instant application contains a Sequence Listing which has been submitted in ASCII format via EFS-Web and is hereby incorporated by reference in its entirety. Said ASCII copy, created on Dec. 9, 2016 is named 32808-716.303.SeqList.txt and is 1,813,891 bytes in size.

STATEMENT REGARDING FEDERALLY SPONSORED RESEARCH

This invention was made with government support under SBIR grant 2R44GM079873-02 awarded by the National Institutes of Health. The government has certain rights in the invention.

BACKGROUND OF THE INVENTION

Human growth hormone (hGH) is a hormone that participates in the regulation of human growth and development. Growth Hormone (herein after "GH"), also known as somatotrophin, represents a class of proteinaceous hormones produced and secreted by the somatotropic cells of the anterior pituitary. Secretion of GH is stimulated by the growth hormone releasing hormone (GHRH) from the hypothalamus and suppressed by somatostatin. This pituitary hormone exhibits a number of biological effects including somatogenesis, lactation, activation of macrophages, insulin-like and diabetogenic effects among others (Chawla, R, K. (1983) Ann. Rev. Med. 34, 519; Edwards, C. K. et al. (1988) Science 239, 769; Thorner, M. O., et al. (1988) J. Clin. Invest. 81, 745). Human growth hormone is a member of a family of homologous hormones that include placental lactogens, prolactins, and other genetic and species variants of GH. GH regulates the secretion of Insulin-like growth factor (IGF-1, formerly known as somatomedin C), among other peptide hormones known collectively as somatomedins, which accounts for most of its biological activity.

A number of diseases and disorders are associated with the deficiency of GH. A deficiency can be congenital, acquired in childhood or in adult life, and can be partial or complete. In some cases, the deficiency is transient, but more commonly is permanent, and may occur in association with deficiencies of other pituitary hormones. Growth hormone deficiency in children leads to dwarfism, growth failure or short stature. Deficiency in adults is rare, but symptoms can include diminished body mass and poor bone density, and a number of psychological symptoms. Other hormonal or glandular disorders frequently coincide with deficiency of growth hormone.

Stimulating the increase in height in childhood is the most widely known effect of GH, and appears to function by at least two mechanisms: GH directly stimulates division and multiplication of chondrocytes of cartilage, and GH also stimulates production of IGF-1. IGF-1 has growth-stimulating effects on a wide variety of tissues. Additional IGF-1 is generated within target tissues, making it apparently both an endocrine and an autocrine/paracrine hormone. IGF-1 also has stimulatory effects on osteoblast and chondrocyte activity to promote bone growth.

Human growth hormone (hGH) plays a key role in somatic growth through its effects on the metabolism of proteins, carbohydrates and lipids. In addition to its effects on somatic growth, hGH has been shown to stimulate blood cells in vitro (Derfalvi et al., 1998; Merchav et al; 1988), to increase erythrocytes and hemoglobin counts (Valerio et al., 1997; Vihervuori et al., 1996), to enhance both proliferation and Ig production in plasma cell lines (Kimata and Yoshida, 1994) and to stimulate $CD8^+$ cell counts and, to a lesser extent $CD4^+$ cell counts (Geffner, 1997).

Injectable forms of GH have been marketed for GH deficiency in children and adults, Turner Syndrome, Prader-Willi Syndrome, and children small for gestational age. In addition, it has seen use in the battle against aging and for weight management, as well as the mobilization of cells capable of regenerating hematopoiesis in the peripheral blood.

The 22 kDA molecular weight of hGH is well below the threshold value for kidney filtration of about 70 kDa (Caliceti (2003) Adv Drug Deliv Rev 55:1261-1277), which contributes to the serum half-life of native hGH being less than 20 minutes in humans. Thus, commercial preparations of hGH must be dosed daily to achieve clinical benefit. A sustained-release form of GH, Nutropin Depot (Genentech and Alkermes) was approved by the FDA in 1999, allowing for fewer injections (every 2 or 4 weeks instead of daily); however, the product was discontinued in 2004.

Chemical modifications to a therapeutic protein can modify its in vivo clearance rate and subsequent serum half-life. One example of a common modification is the addition of a polyethylene glycol (PEG) moiety, typically coupled to the protein via an aldehyde or N-hydroxysuccinimide (NHS) group on the PEG reacting with an amine group (e.g. lysine side chain or the N-terminus). However, the conjugation step can result in the formation of heterogeneous product mixtures that need to be separated, leading to significant product loss and complexity of manufacturing and does not result in a completely chemically-uniform product. Also, the pharmacologic function of GH may be hampered if amino acid side chains in the vicinity of its binding site become modified by the PEGylation process. Other approaches include the genetic fusion of an Fc domain to the therapeutic GH protein. Conjugation of the Fc domain increases the size of the therapeutic protein, hence reducing the rate of clearance through the kidney. Additionally, the Fc domain confers the ability to bind to, and be recycled from lysosomes by, the FcRn receptor, which results in increased pharmacokinetic half-life. Unfortunately, the Fc domain does not fold efficiently during recombinant expression, and tends to form insoluble precipitates known as inclusion bodies. These inclusion bodies must be solubilized and functional protein must be renatured from the misfolded aggregate, a time-consuming, inefficient, and expensive process. Accordingly, there remains a need for growth hormone compositions that can increase the half-life and can be administered less frequently, but are safer and less complicated and costly to produce.

SUMMARY OF THE INVENTION

The present disclosure is directed to compositions and methods that can be useful for or the treatment of any disease, disorder or condition that is improved, ameliorated, or inhibited by the administration of growth hormone. In particular, the present invention provides compositions of fusion proteins comprising one or more extended recombinant polypeptides with a non-repetitive sequence and/or unstructured conformation (XTEN) linked to growth hormone (GH). In part, the present disclosure is directed to pharmaceutical compositions comprising the fusion proteins and the uses thereof for treating growth hormone-related diseases, disorders or conditions.

In one embodiment, the invention provides an isolated fusion protein, comprising a growth hormone that is at least about 90%, or about 95%, or about 96%, or about 97%, or about 98%, or about 99% identical to an amino acid sequence selected from Table 1, wherein said growth hormone is linked to an extended recombinant polypeptide (XTEN) of at least about 100, or at least about 200, or at least about 400, or at least about 800, or at least about 900, or at least about 1000, or at least about 2000, up to about 3000 amino acids residues, wherein the XTEN is characterized in that (a) the XTEN comprises at least about 200 contiguous amino acids that exhibits at least about 90%, or about 95%, or about 96%, or about 97%, or about 98%, or about 99% identical to a comparable length of an amino acid sequence selected from a sequence shown in Table 3; (b) the XTEN sequence lacks a predicted T-cell epitope when analyzed by TEPITOPE algorithm, wherein the TEPITOPE algorithm prediction for epitopes within the XTEN sequence is based on a score of −5, or −6, or −7, or −8, or −9 or greater; (c) the XTEN has a subsequence score of less than 10, or less than 9, or less than 8, or less than 7, or less than 6, or less than 5, or even less; and (d) the sum of glycine (G), alanine (A), serine (S), threonine (T), glutamate (E) and proline (P) residues constitutes more than about 90%, or about 95%, or about 96%, or about 97%, or about 98%, or about 99% of the total amino acid residues of the XTEN. In one embodiment, the growth hormone of the isolated fusion protein is human growth hormone. In another embodiment, the isolated fusion protein comprises at least a second XTEN, wherein the fusion protein adopts a multiple-XTEN configuration shown in Table 5, or a variant thereof.

In another embodiment, the XTEN sequence of the GHXTEN fusion proteins is characterized in that is has greater than 90% random coil formation, or about 95%, or about 96%, or about 97%, or about 98%, or about 99% random coil formation as determined by GOR algorithm; and the XTEN sequence has less than 2% alpha helices and 2% beta-sheets as determined by the Chou-Fasman algorithm.

In another embodiment, the invention provides GHXTEN fusion proteins, wherein the XTEN is characterized in that the sum of asparagine and glutamine residues is less than 10% of the total amino acid sequence of the XTEN, the sum of methionine and tryptophan residues is less than 2% of the total amino acid sequence of the XTEN, the XTEN sequence has less than 5% amino acid residues with a positive charge, the XTEN sequence has greater than 90% random coil formation, or about 95%, or about 96%, or about 97%, or about 98%, or about 99% random coil formation as determined by GOR algorithm; and the XTEN sequence has less than 2% alpha helices and 2% beta-sheets as determined by the Chou-Fasman algorithm.

In another embodiment, the invention provides GHXTEN fusion proteins, wherein the XTEN is characterized in that at least about 80%, or at least about 90%, or at least about 91%, or at least about 92%, or at least about 93%, or at least about 94%, or at least about 95%, or at least about 96%, or at least about 97%, or at least about 98%, or at least about 99% of the XTEN sequence consists of non-overlapping sequence motifs wherein each of the sequence motifs has about 9 to about 14 amino acid residues and wherein the sequence of any two contiguous amino acid residues does not occur more than twice in each of the sequence motifs the sequence motifs consist of four to six types of amino acids selected from glycine (G), alanine (A), serine (S), threonine (T), glutamate (E) and proline (P).

In some embodiments, no one type of amino acid constitutes more than 30% of the XTEN sequence of the GHXTEN. In other embodiments, the XTEN has a sequence in which no three contiguous amino acids are identical unless the amino acid is serine, in which case no more than three contiguous amino acids are serine residues. In still other embodiments, at least about 80%, or about 90%, or about 95%, or about 96%, or about 97%, or about 98%, or about 99%, or 100% of the XTEN sequence consists of non-overlapping sequence motifs, wherein each of the sequence motifs has 12 amino acid residues. In one embodiment, the XTEN sequence consists of non-overlapping sequence motifs, wherein the sequence motifs are from one or more sequences of Table 2.

In some embodiments, GHXTEN fusion proteins exhibits enhanced pharmacokinetic properties compared to GH not linked to XTEN, wherein the enhanced properties include but are not limited to longer terminal half-life, larger area under the curve, increased time in which the blood concentration remains within the therapeutic window, increased time between consecutive doses, and decreased dose in moles over time. In some embodiments, the terminal half-life of the GHXTEN fusion protein administered to a subject is increased at least about two fold, or at least about three-fold, or at least about four-fold, or at least about five-fold, or at least about six-fold, or at least about eight-fold, or at least about ten-fold, or at least about 20-fold, or at least about 40-fold, or at least about 60-fold, or at least about 100-fold, or even higher as compared to GH not linked to XTEN and administered to a subject at a comparable dose. In other embodiments, the enhanced pharmacokinetic property is reflected by the fact that the blood concentrations that remain within the therapeutic window for the GHXTEN fusion protein for a given period are at least about two fold, or at least about three-fold, or at least about four-fold, or at least about five-fold, or at least about six-fold, or at least about eight-fold, or at least about ten-fold longer, or at least about 20-fold, or at least about 40-fold, or at least about 60-fold, or at least about 100-fold compared to GH not linked to XTEN and administered to a subject at a comparable dose. The increase in half-life and time spent within the therapeutic window permits less frequent dosing and decreased amounts of the fusion protein (in moles equivalent) that are administered to a subject, compared to the corresponding GH not linked to XTEN. In one embodiment, the therapeutically effective dose regimen results in a gain in time of at least two-fold, or at least three-fold, or at least four-fold, or at least five-fold, or at least six-fold, or at least eight-fold, or at least 10-fold, or at least about 20-fold, or at least about 40-fold, or at least about 60-fold, or at least about 100-fold between at least two consecutive $C_{max}$ peaks and/or $C_{min}$ troughs for blood levels of the fusion protein compared to the corresponding GH not linked to the fusion protein and administered using a comparable dose regimen to a subject.

In some embodiments, the XTEN enhances thermostability of a biologically active protein when linked to the biologically active protein wherein the thermostability is ascertained by measuring the retention of biological activity after exposure to a temperature of about 37° C. for at least about 7 days of the biologically active protein in comparison to the XTEN linked to the biologically active protein. In one embodiment of the foregoing, the retention of biological activity in increased by at least about 50%, at least about 60%, at least about 70%, at least about 80%, at least about 90%, at least about 100%, or about 150%, at least about 200%, at least about 300%, or about 500% longer compared to the GH not linked to the XTEN comprises of the XTEN.

In some embodiments, the isolated fusion protein with at least a first XTEN comprises a GH wherein the GH is human growth hormone. In some embodiments, the isolated fusion protein further comprises a second XTEN, which can be identical or can be different from the first XTEN, and wherein the fusion protein adopts a multiple-XTEN configuration shown in Table 5. In one embodiment of the foregoing, the first and the second XTEN can each be a sequence selected from Table 3, or can exhibit at least at least about 80%, or at least about 90%, or at least about 91%, or at least about 92%, or at least about 93%, or at least about 94%, or at least about 95%, or at least about 96%, or at least about 97%, or at least about 98%, or at least about 99% or 100% sequence identity to a sequence selected from Table 3. In another embodiment, the isolated fusion protein comprising a second XTEN sequence adopts a multiple-XTEN configuration shown in Table 5.

In one embodiment, the isolated fusion protein is less immunogenic compared to the GH not linked to the XTEN, wherein immunogenicity is ascertained by, e.g., measuring production of IgG antibodies selectively binding to the biologically active protein after administration of comparable doses to a subject.

In some embodiments, the growth hormone peptide and the XTEN of the fusion protein is linked via a spacer, wherein the spacer sequence comprises between about 1 to about 50 amino acid residues that optionally comprises a cleavage sequence. In one embodiment, the cleavage sequence is susceptible to cleavage by a protease. Non-limiting examples of such protease include FXIa, FXIIa, kallikrein, FVIIa, FIXa, FXa, thrombin, elastase-2, granzyme B, MMP-12, MMP-13, MMP-17 or MMP-20, TEV, enterokinase, rhinovirus 3C protease, and sortase A.

In some embodiments, the isolated fusion protein is configured to have reduced binding affinity for a target receptor of the corresponding GH, as compared to the corresponding GH not linked to the fusion protein. In one embodiment, the GHXTEN fusion protein exhibits binding affinity for a target receptor of the GH in the range of about 0.01%-30%, or about 0.1% to about 20%, or about 1% to about 15%, or about 2% to about 10% of the binding affinity of the corresponding GH that lacks the XTEN. In another embodiment, the GHXTEN fusion protein exhibits binding affinity for a target receptor of the GH that is reduced at least about 3-fold, or at least about 5-fold, or at least about 6-fold, or at least about 7-fold, or at least about 8-fold, or at least about 9-fold, or at least about 10-fold, or at least about 12-fold, or at least about 15-fold, or at least about 17-fold, or at least about 20-fold, or at least about 30-fold, or at least about 50-fold, or at least about 100-fold less binding affinity compared to GH not linked to XTEN. In a related embodiment, a fusion protein with reduced affinity can have reduced receptor-mediated clearance and a corresponding increase in half-life of at least about 3-fold, or at least about 5-fold, or at least about 6-fold, or at least about 7-fold, or at least about 8-fold, or at least about 9-fold, or at least about 10-fold, or at least about 12-fold, or at least about 15-fold, or at least about 17-fold, or at least about 20-fold, or at least about 30-fold, or at least about 50-fold, or at least about 100-fold longer compared to the corresponding GH that is not linked to the fusion protein.

In one embodiment, the invention provides an isolated GHXTEN fusion protein comprising an amino acids sequence that has at least about 80%, or at least about 90%, or at least about 91%, or at least about 92%, or at least about 93%, or at least about 94%, or at least about 95%, or at least about 96%, or at least about 97%, or at least about 98%, or at least about 99%, or 100% sequence identity to a sequence selected from Table 35, Table 36, and Table 37.

In some embodiments, the invention provides GHXTEN fusion proteins wherein the GHXTEN exhibits increased solubility of at least three-fold, or at least about four-fold, or at least about five-fold, or at least about six-fold, or at least about seven-fold, or at least about eight-fold, or at least about nine-fold, or at least about ten-fold, or at least about 15-fold, or at least a 20-fold, or at least 40-fold, or at least 60-fold at physiologic conditions compared to the GH not linked to the fusion protein.

In some embodiments, GHXTEN fusion proteins exhibit an increased apparent molecular weight as determined by size exclusion chromatography, compared to the actual molecular weight, wherein the apparent molecular weight is at least about 100 kD, or at least about 150 kD, or at least about 200 kD, or at least about 300 kD, or at least about 400 kD, or at least about 500 kD, or at least about 600 kD, or at least about 700 kD, while the actual molecular weight of each GH component of the fusion protein is less than about 25 kD. Accordingly, the GHXTEN fusion proteins can have an Apparent Molecular Weight that is about 4-fold greater, or about 5-fold greater, or about 6-fold greater, or about 7-fold greater, or about 8-fold greater than the actual molecular weight of the fusion protein. In some cases, the isolated GHXTEN fusion protein of the foregoing embodiments exhibits an apparent molecular weight factor under physiologic conditions that is greater than about 4, or about 5, or about 6, or about 7, or about 8.

The invention contemplates GHXTEN fusion proteins compositions comprising, but not limited to GH selected from Table 1 (or fragments or sequence variants thereof), XTEN selected from Table 3 (or sequence variants thereof) that are in a configuration selected from Table 5. Generally, the resulting GHXTEN will retain at least a portion of the biological activity of the corresponding GH not linked to the XTEN. In other cases, the GH component either becomes biologically active or has an increase in activity upon its release from the XTEN by cleavage of an optional cleavage sequence incorporated within spacer sequences into the GHXTEN.

In one embodiment of the GHXTEN composition, the invention provides a fusion protein of formula I:

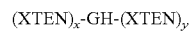   I wherein independently for each occurrence, GH is a is a growth hormone; x is either 0 or 1 and y is either 0 or 1 wherein x+y≥1; and XTEN is an extended recombinant polypeptide.

In some embodiments, the XTEN is fused to the growth hormone on an N- or C-terminus of the growth hormone. In some embodiments, the isolated fusion protein comprises a human growth hormone and a first and a second XTEN selected from AE912, AM923, AE144, and AE288.

In another embodiment of the GHXTEN composition, the invention provides a fusion protein of formula II:

$$(XTEN)_x\text{-}(GH)\text{-}(S)_y\text{-}(XTEN)_y \qquad \text{II}$$

wherein independently for each occurrence, GH is a is a growth hormone; S is a spacer sequence having between 1 to about 50 amino acid residues that can optionally include a cleavage sequence; x is either 0 or 1 and y is either 0 or 1 wherein x+y≥1; and XTEN is an extended recombinant polypeptide.

In another embodiment, the invention provides an isolated fusion protein, wherein the fusion protein is of formula III:

$$(GH)\text{-}(S)_x\text{-}(XTEN)\text{-}(S)_y\text{-}(GH)\text{-}(S)_z\text{-}(XTEN)_z \qquad \text{III}$$

wherein independently for each occurrence, GH is a is a growth hormone; S is a spacer sequence having between 1 to about 50 amino acid residues that can optionally include a cleavage sequence; x is either 0 or 1; y is either 0 or 1; z is either 0 or 1; and XTEN is an extended recombinant polypeptide.

In another embodiment, the invention provides an isolated fusion protein, wherein the fusion protein is of formula IV:

$$(XTEN)_x\text{-}(S)_y\text{-}(GH)\text{-}(S)_z\text{-}(XTEN)\text{-}(GH) \qquad \text{IV}$$

wherein independently for each occurrence, GH is a is a growth hormone; S is a spacer sequence having between 1 to about 50 amino acid residues that can optionally include a cleavage sequence; x is either 0 or 1; y is either 0 or 1; z is either 0 or 1; and XTEN is an extended recombinant polypeptide.

In another embodiment, the invention provides an isolated fusion growth hormone, wherein the fusion protein is of formula V:

$$(GH)_x\text{-}(S)_x\text{-}(GH)\text{-}(S)_y\text{-}(XTEN) \qquad \text{V}$$

wherein independently for each occurrence, GH is a is a growth hormone; S is a spacer sequence having between 1 to about 50 amino acid residues that can optionally include a cleavage sequence; x is either 0 or 1; y is either 0 or 1; and XTEN is an extended recombinant polypeptide.

In another embodiment, the invention provides an isolated fusion protein, wherein the fusion protein is of formula VI:

$$(XTEN)\text{-}(S)_x\text{-}(GH)\text{-}(S)_y\text{-}(GH) \qquad \text{VI}$$

wherein independently for each occurrence, GH is a is a growth hormone; S is a spacer sequence having between 1 to about 50 amino acid residues that can optionally include a cleavage sequence; x is either 0 or 1; y is either 0 or 1; and XTEN is an extended recombinant polypeptide.

In another embodiment, the invention provides an isolated fusion protein, wherein the fusion protein is of formula VII:

$$(XTEN)\text{-}(S)_x\text{-}(GH)\text{-}(S)_y\text{-}(GH)\text{-}(XTEN) \qquad \text{VII}$$

wherein independently for each occurrence, GH is a is a growth hormone; S is a spacer sequence having between 1 to about 50 amino acid residues that can optionally include a cleavage sequence; x is either 0 or 1; y is either 0 or 1; and XTEN is an extended recombinant polypeptide.

In another embodiment, the invention provides an isolated fusion protein, wherein the fusion protein is of formula VIII:

$$((S)_m\text{-}(GH)_x\text{-}(S)_n\text{-}(XTEN)_y\text{-}(S)_o)_t \qquad \text{VIII}$$

wherein t is an integer that is greater than 0 (1, 2, 3, etc.); independently each of m, n, o, x, and y is an integer (0, 1, 2, 3, etc.), GH is a is a growth hormone; S is an spacer, optionally comprises a cleavage site; and XTEN is an extended recombinant polypeptide, with the proviso that: (1) x+y>1, (2) when t=1, x>0 and y>0, (3) when there is more than one GH, S, or XTEN, each GH, XTEN, or S are the same or are independently different; and (4) when t>1, each m, n, o, x, or y within each subunit are the same or are independently different.

In some embodiments, administration of a therapeutically effective dose of a fusion protein of an embodiment of formulas I-VIII to a subject in need thereof can result in a gain in time of at least two-fold, or at least three-fold, or at least four-fold, or at least five-fold or more spent within a therapeutic window for the fusion protein compared to the corresponding GH not linked to the XTEN of and administered at a comparable dose to a subject. In other cases, administration of a therapeutically effective dose of a fusion protein of an embodiment of formulas I-VIII to a subject in need thereof can result in a gain in time between consecutive doses necessary to maintain a therapeutically effective dose regimen of at least 48 h, or at least 72 h, or at least about 96 h, or at least about 120 h, or at least about 7 days, or at least about 14 days, or at least about 21 days between consecutive doses compared to a GH not linked to XTEN and administered at a comparable dose.

The fusion proteins can be designed to have different configurations, N- to C-terminus, of a GH, XTEN, and optional spacer sequences, including but not limited to XTEN-GH, GH-XTEN, XTEN-S-GH, GH-S-XTEN, XTEN-GH-XTEN, GH-GH-XTEN, XTEN-GH-GH, GH-S-GH-XTEN, XTEN-GH-S-GH, and multimers thereof. The choice of configuration can, as disclosed herein, confer particular pharmacokinetic, physico/chemical, or pharmacologic properties.

In some embodiments, the isolated fusion protein is characterized in that: (i) it has a longer half-life compared to the corresponding growth hormone that lacks the XTEN; (ii) when a smaller molar amount of the fusion protein is administered to a subject in comparison to the corresponding growth hormone that lacks the XTEN administered to a subject under an otherwise equivalent dose regimen, the fusion protein achieves a comparable area under the curve (AUC) as the corresponding growth hormone that lacks the XTEN; (iii) when a smaller molar amount of the fusion protein is administered to a subject in comparison to the corresponding growth hormone that lacks the XTEN administered to a subject under an otherwise equivalent dose regimen, the fusion protein achieves a comparable therapeutic effect as the corresponding growth hormone that lacks the XTEN; (iv) when the fusion protein is administered to a subject less frequently in comparison to the corresponding growth hormone that lacks the XTEN administered to a subject using an otherwise equivalent molar amount, the fusion protein achieves a comparable area under the curve (AUC) as the corresponding growth hormone that lacks the XTEN; (v) when the fusion protein is administered to a subject less frequently in comparison to the corresponding growth hormone that lacks the XTEN administered to a subject using an otherwise equivalent molar amount, the fusion protein achieves a comparable therapeutic effect as the corresponding growth hormone that lacks the XTEN; (vi) when an accumulatively smaller molar amount of the fusion protein is administered to a subject in comparison to the corresponding growth hormone that lacks the XTEN administered to a subject under an otherwise equivalent dose period, the fusion protein achieves comparable area under the curve (AUC) as the corresponding growth hormone that lacks the XTEN; or (vii) when an accumulatively smaller molar amount of the fusion protein is administered to a subject in comparison to the corresponding growth hormone that lacks the XTEN administered to a subject under an otherwise equivalent dose period, the fusion protein achieves comparable therapeutic effect as the corresponding growth hormone that lacks the XTEN.

In one embodiment, the GHXTEN fusion proteins of formulas I-VIII described above exhibit a biological activity of at least about 0.1%, or at least about 0.1%, or at least about 1%, or at least about 2%, or at least about 3%, or at least about 4%, or at least about 5%, or at least about 10%, or at least about 20%, or at least about 30%, or at least about 40%, or at least about 50%, or at least about 60%, or at least about 70%, or at least about 80%, or at least about 90%, or at least about 95% of the biological activity compared to the GH not linked to the fusion protein. In another embodiment, the GHXTEN fusion proteins of formulas I-VIII bind the same receptors or ligands as the corresponding parental biologically active protein that is not covalently linked to the fusion protein.

The invention provides a method of producing a fusion protein comprising a growth hormone fused to one or more extended recombinant polypeptides (XTEN), comprising: (a) providing host cell comprising a recombinant polynucleotide molecule encoding the fusion protein (b) culturing the host cell under conditions permitting the expression of the fusion protein; and (c) recovering the fusion protein. In one embodiment of the method, the growth hormone of the fusion protein has at least 90% sequence identity to human growth hormone or a sequence selected from Table 1. In another embodiment of the method, the one or more XTEN of the expressed fusion protein has at least about 90%, or about 91%, or about 92%, or about 93%, or about 94%, or about 95%, or about 96%, or about 97%, or about 98%, or about 99% to about 100% sequence identity to a sequence selected from Table 3. In another embodiment of the method, the polynucleotide encoding the XTEN is codon optimized for enhanced expression of said fusion protein in the host cell. In another embodiment of the method, the host cell is a prokaryotic cell. In another embodiment of the method, the host cell is E. coli. In another embodiment of the method the isolated fusion protein is recovered from the host cell cytoplasm in substantially soluble form.

The invention provides isolated nucleic acids comprising a polynucleotide sequence selected from (a) a polynucleotide encoding the fusion protein of any of the foregoing embodiments, or (b) the complement of the polynucleotide of (a). In one embodiment, the invention provides an isolated nucleic acid comprising a polynucleotide sequence that has at least 80% sequence identity, or about 85%, or at least about 90%, or about 91%, or about 92%, or about 93%, or about 94%, or about 95%, or about 96%, or about 97%, or about 98%, or about 99% to about 100% sequence identity to (a) a polynucleotide sequence of comparable length selected from Table 35, Table 36, and Table 37; or (b) the complement of the polynucleotide of (a). The invention provides expression vectors comprising the nucleic acid of any of the embodiments hereinabove described in this paragraph. In one embodiment, the expression vector of the foregoing further comprises a recombinant regulatory sequence operably linked to the polynucleotide sequence. In another embodiment, the polynucleotide sequence of the expression vectors of the foregoing is fused in frame to a polynucleotide encoding a secretion signal sequence, which can be a prokaryotic signal sequence. In one embodiment, the secretion signal sequence is selected from OmpA, DsbA, and PhoA signal sequences.

The invention provides a host cell, which can comprise an expression vector disclosed in the foregoing paragraph. In one embodiment, the host cell is a prokaryotic cell. In another embodiment, the host cell is E. coli. In another embodiment, the host cell is a eukaryotic cell.

In one embodiment, the invention provides pharmaceutical compositions comprising the fusion protein of any of the foregoing embodiments and a pharmaceutically acceptable carrier. In another embodiment, the invention provides kits, comprising packaging material and at least a first container comprising the pharmaceutical composition of the foregoing embodiment and a label identifying the pharmaceutical composition and storage and handling conditions, and a sheet of instructions for the reconstitution and/or administration of the pharmaceutical compositions to a subject.

The invention provides a method of treating a growth-hormone related condition in a subject, comprising administering to the subject a therapeutically effective amount of the fusion protein of any of the foregoing embodiments. In one embodiment of the method, the growth-hormone related condition is selected from growth-hormone deficiency, Turner's Syndrome, Prader-Willi Syndrome, idiopathic short stature, AIDS wasting, multiple sclerosis, Crohn's disease, ulcerative colitis, and muscular dystrophy.

In some embodiments, the composition can be administered subcutaneously, intramuscularly, or intravenously. In one embodiment, the composition is administered at a therapeutically effective amount. In one embodiment, the therapeutically effective amount results in a gain in time spent within a therapeutic window for the fusion protein compared to the corresponding GH of the fusion protein not linked to the fusion protein and administered at a comparable dose to a subject. The gain in time spent within the therapeutic window can at least three-fold longer than the corresponding GH not linked to the fusion protein, or alternatively, at least four-fold, or five-fold, or six-fold, or seven-fold, or eight-fold, or nine-fold, or at least 10-fold, or at least 20-fold, or at least about 30-fold, or at least about 50-fold, or at least about 100-fold longer than the corresponding GH not linked to the fusion protein. In some embodiments of the method of treatment, (i) a smaller molar amount of (e.g. of about two-fold less, or about three-fold less, or about four-fold less, or about five-fold less, or about six-fold less, or about eight-fold less, or about 100 fold-less or greater) the fusion protein is administered in comparison to the corresponding growth hormone that lacks the XTEN under an otherwise same dose regimen, and the fusion protein achieves a comparable area under the curve and/or a comparable therapeutic effect as the corresponding growth hormone that lacks the XTEN; (ii) the fusion protein is administered less frequently (e.g., every two days, about every seven days, about every 14 days, about every 21 days, or about, monthly) in comparison to the corresponding growth hormone that lacks the XTEN under an otherwise same dose amount, and the fusion protein achieves a comparable area under the curve and/or a comparable therapeutic effect as the corresponding growth hormone that lacks the XTEN; or (iii) an accumulative smaller molar amount (e.g. about 5%, or about 10%, or about 20%, or about 40%, or about 50%, or about 60%, or about 70%, or about 80%, or about 90% less) of the fusion protein is administered in comparison to the corresponding growth hormone that lacks the XTEN under the otherwise same dose regimen the fusion protein achieves a comparable area under the curve and/or a comparable therapeutic effect as the corresponding growth hormone that lacks the XTEN. The accumulative smaller molar amount is measure for a period of at least about one week, or about 14 days, or about 21 days, or about one month. In some embodiments of the method, the therapeutic effect is a measured parameter selected from IGF-1 concentrations, IGFBP3 concentration, height velocity, lean body mass, total body fat, trunk fat, response to insulin challenge, rate of division of chondrocytes, chondrocyte numbers, bone density, bone growth, and increase in epiphyseal plate width.

In another embodiment, invention provides a method of treating a disease, disorder or condition, comprising administering the pharmaceutical composition described above to a subject using multiple consecutive doses of the pharmaceutical composition administered using a therapeutically effective dose regimen. In one embodiment of the foregoing, the therapeutically effective dose regimen can result in a gain in time of at least three-fold, or alternatively, at least four-fold, or five-fold, or six-fold, or seven-fold, or eight-fold, or nine-fold, or at least 10-fold, or at least 20-fold, or at least about 30-fold, or at least about 50-fold, or at least about 100-fold longer time between at least two consecutive $C_{max}$ peaks and/or $C_{min}$ troughs for blood levels of the fusion protein compared to the corresponding GH of the fusion protein not linked to the fusion protein and administered at a comparable dose regimen to a subject. In another embodiment of the foregoing, the administration of the fusion protein results in at least one measured parameter of improvement in at least one measured parameter of a growth hormone-related disease using less frequent dosing or a lower total dosage in moles of the fusion protein of the pharmaceutical composition compared to the corresponding biologically active protein component (s) not linked to the fusion protein and administered to a subject d using a therapeutically effective regimen to a subject.

The invention further provides use of the compositions comprising the fusion protein of any of the foregoing embodiments in the preparation of a medicament for treating a disease, disorder or condition in a subject in need thereof. In one embodiment of the foregoing, the disease, disorder or condition is selected from group consisting of Turner's Syndrome, Prader-Willi Syndrome, idiopathic short stature, AIDS wasting, multiple sclerosis, Crohn's disease, ulcerative colitis, and muscular dystrophy. Any of the disclosed embodiments can be practiced alone or in combination depending on the interested application.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

The features and advantages of the invention may be further explained by reference to the following detailed description and accompanying drawings that sets forth illustrative embodiments.

FIG. 1A shows two different configurations of GHXTEN fusion proteins (100), each comprising a single growth hormone (GH) and an XTEN, the first of which has an XTEN molecule (102) attached to the C-terminus of a GH (103), and the second of which has an XTEN molecule attached to the N-terminus of a GH (103). FIG. 1B shows two different configurations of GHXTEN fusion proteins (100), each comprising a single GH, a spacer sequence and an XTEN, the first of which has an XTEN molecule (102) attached to the C-terminus of a spacer sequence (104) and the spacer sequence attached to the C-terminus of a GH (103) and the second of which has an XTEN molecule attached to the N-terminus of a spacer sequence (104) and the spacer sequence attached to the N-terminus of a GH (103). FIG. 1C shows two different configurations of GHXTEN fusion proteins (101), each comprising two molecules of a single GH and one molecule of an XTEN, the first of which has an XTEN linked to the C-terminus of a first GH and that GH is linked to the C-terminus of a second GH, and the second of which is in the opposite orientation in which the XTEN is linked to the N-terminus of a first GH and that GH is linked to the N-terminus of a second GH. FIG. 1D shows two different configurations of GHXTEN fusion proteins (101), each comprising two molecules of a single GH, a spacer sequence and one molecule of an XTEN, the first of which has an XTEN linked to the C-terminus of a spacer sequence and the spacer sequence linked to the C-terminus of a first GH which is linked to the C-terminus of a second GH, and the second of which is in the opposite orientation in which the XTEN is linked to the N-terminus of a spacer sequence and the spacer sequence is linked to the N-terminus of a first GH that that GH is linked to the N-terminus of a second GH. FIG. 1E shows two different configurations of GHXTEN fusion proteins (101), each comprising two molecules of a single GH, a spacer sequence and one molecule of an XTEN, the first of which has an XTEN linked to the C-terminus of a first GH and the first GH linked to the C-terminus of a spacer sequence which is linked to the C-terminus of a second GH molecule, and the second of which is in the opposite configuration of XTEN linked to the N-terminus of a first GH which is linked to the N-terminus of a spacer sequence which in turn is linked to the N-terminus of a second molecule of GH. FIG. 1F shows a configuration of GHXTEN fusion protein (105), each comprising one molecule of GH and two molecules of an XTEN linked to the N-terminus and the C-terminus of the GH. FIG. 1G shows a configuration (106) of a single GH linked to two XTEN, with the second XTEN separated from the GH by a spacer sequence. FIG. 1H s a configuration (106) of a two GH linked to two XTEN, with the second XTEN linked to the C-terminus of the first GH and the N-terminus of the second GH, which is at the C-terminus of the GHXTEN.

FIG. 3D shows that the bound GHXTEN (100) with high binding affinity remains bound to the receptor (106) and has been internalized into an endosome (110) within the cell, illustrating receptor-mediated clearance of the bound GH and triggering cell signaling (109), portrayed as stippled cytoplasm.

FIG. 7 is a schematic representation of the design of GHXTEN expression vectors with different processing strategies. FIG. 7A shows an exemplary expression vector encoding XTEN fused to the 3' end of the sequence encoding GH. Note that no additional leader sequences are required in this vector. FIG. 7B depicts an expression vector encoding XTEN fused to the 5' end of the sequence encoding GH with a CBD leader sequence and a TEV protease site. FIG. 7C depicts an expression vector as in FIG. 7B where the CBD and TEV processing site have been replaced with an optimized N-terminal leader sequence (NTS). FIG. 7D depicts an expression vector encoding an NTS sequence, an XTEN, a sequence encoding GH, and than a second sequence encoding an XTEN.

FIG. 10 shows three randomized libraries used for the third and fourth codons in the N-terminal sequences of clones from LCW546, LCW547 and LCW552. The libraries were designed with the third and fourth residues modified such that all combinations of allowable XTEN codons were present at these positions, as shown. In order to include all the allowable XTEN codons for each library, nine pairs of oligonucleotides encoding 12 amino acids with codon diversities of third and fourth residues were designed, annealed and ligated into the NdeI/BsaI restriction enzyme digested stuffer vector pCW0551 (Stuffer-XTEN_AM875-GFP), and transformed into *E. coli* BL21Gold(DE3) competent cells to obtain colonies of the three libraries LCW0569 (SEQ ID NOS 845-846, respectively, in order of appearance), LCW0570 (SEQ ID NOS 847-848, respectively, in order of appearance), and LCW0571 (SEQ ID NOS 849-850, respectively, in order of appearance).

FIG. 17 shows the effects of heat treatment on stability of hGH and AM864-hGH, as described in Example 26. FIG. 17A is an SDS-PAGE gel of the two preparations treated at 25° C. and 80° C. for 15 minutes, while FIG. 17B shows the corresponding percentage of receptor binding activity of the 80° C. sample relative to the 25° C. treatment, indicating that the XTEN conferred heat stability and retention of activity to the hGH and the GHXTEN fusion protein.

FIG. 21 shows size exclusion chromatography profiles of two GHXTEN constructs Y576-GH and hGH-Y576 (N- to C-terminus), shown as an overlay, as described in Example 24.

FIG. 26 shows the comparative effects of administration of placebo, hGH, and AM864-hGH on growth of cartilage in the tibial epiphyseal plate in hypox rats, shown in histologic cross-sections of the tibia after 9 days of treatment, as described in Example 29.

FIG. 36 illustrates allometric scaling results for predicted human response to Ex4-XTEN_AE864 based on measured results from four animal species; i.e., mice, rats, cynomolgus monkeys and dogs. FIG. 36A shows measured terminal half-life versus body mass, with a predicted T1/2 in humans of 139 h. FIG. 36B shows measured drug clearance versus body mass, with a predicted clearance rate value of 30 ml/h in humans. FIG. 36C shows measured volume of distribution versus body mass, with a predicted value of 5970 ml in humans.

DETAILED DESCRIPTION OF THE INVENTION

Figure 1:
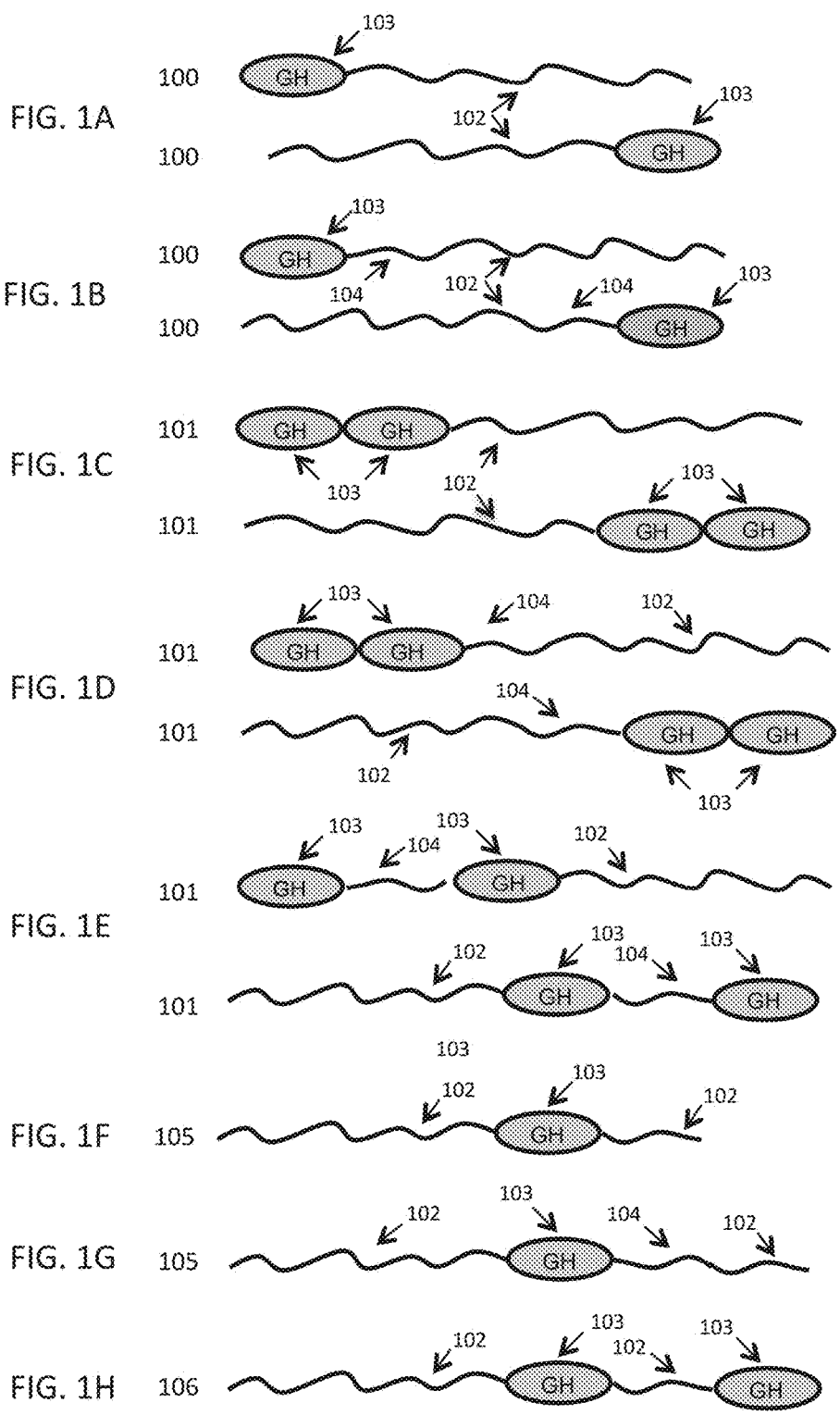
FIG. 1 shows schematic representations of exemplary GHXTEN fusion proteins (FIGS. 1A-H), all depicted in an N- to C-terminus orientation.

Before the embodiments of the invention are described, it is to be understood that such embodiments are provided by way of example only, and that various alternatives to the embodiments of the invention described herein may be employed in practicing the invention. Numerous variations, changes, and substitutions will now occur to those skilled in the art without departing from the invention.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. In case of conflict, the patent specification, including definitions, will control. In addition, the materials, methods, and examples are illustrative only and not intended to be limiting. Numerous variations, changes, and substitutions will now occur to those skilled in the art without departing from the invention.

Definitions

As used herein, the following terms have the meanings ascribed to them unless specified otherwise.

As used in the specification and claims, the singular forms "a", "an" and "the" include plural references unless the context clearly dictates otherwise. For example, the term "a cell" includes a plurality of cells, including mixtures thereof.

The terms "polypeptide", "peptide", and "protein" are used interchangeably herein to refer to polymers of amino acids of any length. The polymer may be linear or branched, it may comprise modified amino acids, and it may be interrupted by non-amino acids. The terms also encompass an amino acid polymer that has been modified, for example, by disulfide bond formation, glycosylation, lipidation, acetylation, phosphorylation, or any other manipulation, such as conjugation with a labeling component.

As used herein the term "amino acid" refers to either natural and/or unnatural or synthetic amino acids, including but not limited to glycine and both the D or L optical isomers, and amino acid analogs and peptidomimetics. Standard single or three letter codes are used to designate amino acids.

The term "natural L-amino acid" means the L optical isomer forms of glycine (G), proline (P), alanine (A), valine (V), leucine (L), isoleucine (I), methionine (M), cysteine (C), phenylalanine (F), tyrosine (Y), tryptophan (W), histidine (H), lysine (K), arginine (R), glutamine (Q), asparagine (N), glutamic acid (E), aspartic acid (D), serine (S), and threonine (T).

The term "non-naturally occurring," as applied to sequences and as used herein, means polypeptide or polynucleotide sequences that do not have a counterpart to, are not complementary to, or do not have a high degree of homology with a wild-type or naturally-occurring sequence found in a mammal. For example, a non-naturally occurring polypeptide or fragment may share no more than 99%, 98%, 95%, 90%, 80%, 70%, 60%, 50% or even less amino acid sequence identity as compared to a natural sequence when suitably aligned.

The terms "hydrophilic" and "hydrophobic" refer to the degree of affinity that a substance has with water. A hydrophilic substance has a strong affinity for water, tending to dissolve in, mix with, or be wetted by water, while a hydrophobic substance substantially lacks affinity for water, tending to repel and not absorb water and tending not to dissolve in or mix with or be wetted by water Amino acids can be characterized based on their hydrophobicity. A number of scales have been developed. An example is a scale developed by Levitt, M, et al., J Mol Biol (1976) 104:59, which is listed in Hopp, T P, et al., Proc Natl Acad Sci USA (1981) 78:3824. Examples of "hydrophilic amino acids" are arginine, lysine, threonine, alanine, asparagine, and glutamine. Of particular interest are the hydrophilic amino acids aspartate, glutamate, and serine, and glycine. Examples of "hydrophobic amino acids" are tryptophan, tyrosine, phenylalanine, methionine, leucine, isoleucine, and valine.

A "fragment" is a truncated form of a native biologically active protein that retains at least a portion of the therapeutic and/or biological activity. A "variant" is a protein with sequence homology to the native biologically active protein that retains at least a portion of the therapeutic and/or biological activity of the biologically active protein. For example, a variant protein may share at least 70%, 75%, 80%, 85%, 90%, 95%, 96%, 97%, 98% or 99% amino acid sequence identity with the reference biologically active protein. As used herein, the term "biologically active protein moiety" includes proteins modified deliberately, as for example, by site directed mutagenesis, insertions, or accidentally through mutations.

A "host cell" includes an individual cell or cell culture which can be or has been a recipient for the subject vectors. Host cells include progeny of a single host cell. The progeny may not necessarily be completely identical (in morphology or in genomic of total DNA complement) to the original parent cell due to natural, accidental, or deliberate mutation. A host cell includes cells transfected in vivo with a vector of this invention.

"Isolated," when used to describe the various polypeptides disclosed herein, means polypeptide that has been identified and separated and/or recovered from a component of its natural environment. Contaminant components of its natural environment are materials that would typically interfere with diagnostic or therapeutic uses for the polypeptide, and may include enzymes, hormones, and other proteinaceous or non-proteinaceous solutes. As is apparent to those of skill in the art, a non-naturally occurring polynucleotide, peptide, polypeptide, protein, antibody, or fragments thereof, does not require "isolation" to distinguish it from its naturally occurring counterpart. In addition, a "concentrated", "separated" or "diluted" polynucleotide, peptide, polypeptide, protein, antibody, or fragments thereof, is distinguishable from its naturally occurring counterpart in that the concentration or number of molecules per volume is generally greater than that of its naturally occurring counterpart. In general, a polypeptide made by recombinant means and expressed in a host cell is considered to be "isolated."

An "isolated" polynucleotide or polypeptide-encoding nucleic acid or other polypeptide-encoding nucleic acid is a nucleic acid molecule that is identified and separated from at least one contaminant nucleic acid molecule with which it is ordinarily associated in the natural source of the polypeptide-encoding nucleic acid. An isolated polypeptide-encoding nucleic acid molecule is other than in the form or setting in which it is found in nature. Isolated polypeptide-encoding nucleic acid molecules therefore are distinguished from the specific polypeptide-encoding nucleic acid molecule as it exists in natural cells. However, an isolated polypeptide-encoding nucleic acid molecule includes polypeptide-encoding nucleic acid molecules contained in cells that ordinarily express the polypeptide where, for example, the nucleic acid molecule is in a chromosomal or extra-chromosomal location different from that of natural cells.

A "chimeric" protein contains at least one fusion polypeptide comprising regions in a different position in the sequence than that which occurs in nature. The regions may normally exist in separate proteins and are brought together in the fusion polypeptide; or they may normally exist in the same protein but are placed in a new arrangement in the fusion polypeptide. A chimeric protein may be created, for example, by chemical synthesis, or by creating and translating a polynucleotide in which the peptide regions are encoded in the desired relationship.

"Conjugated", "linked," "fused," and "fusion" are used interchangeably herein. These terms refer to the joining together of two or more chemical elements or components, by whatever means including chemical conjugation or recombinant means. For example, a promoter or enhancer is operably linked to a coding sequence if it affects the transcription of the sequence. Generally, "operably linked" means that the DNA sequences being linked are contiguous, and in reading phase or in-frame. An "in-frame fusion" refers to the joining of two or more open reading frames (ORFs) to form a continuous longer ORF, in a manner that maintains the correct reading frame of the original ORFs. Thus, the resulting recombinant fusion protein is a single protein containing two or more segments that correspond to polypeptides encoded by the original ORFs (which segments are not normally so joined in nature).

In the context of polypeptides, a "linear sequence" or a "sequence" is an order of amino acids in a polypeptide in an amino to carboxyl terminus direction in which residues that neighbor each other in the sequence are contiguous in the primary structure of the polypeptide. A "partial sequence" is a linear sequence of part of a polypeptide that is known to comprise additional residues in one or both directions.

"Heterologous" means derived from a genotypically distinct entity from the rest of the entity to which it is being compared. For example, a glycine rich sequence removed from its native coding sequence and operatively linked to a coding sequence other than the native sequence is a heterologous glycine rich sequence. The term "heterologous" as applied to a polynucleotide, a polypeptide, means that the polynucleotide or polypeptide is derived from a genotypically distinct entity from that of the rest of the entity to which it is being compared.

The terms "polynucleotides", "nucleic acids", "nucleotides" and "oligonucleotides" are used interchangeably. They refer to a polymeric form of nucleotides of any length, either deoxyribonucleotides or ribonucleotides, or analogs thereof. Polynucleotides may have any three-dimensional structure, and may perform any function, known or unknown. The following are non-limiting examples of polynucleotides: coding or non-coding regions of a gene or gene fragment, loci (locus) defined from linkage analysis, exons, introns, messenger RNA (mRNA), transfer RNA, ribosomal RNA, ribozymes, cDNA, recombinant polynucleotides, branched polynucleotides, plasmids, vectors, isolated DNA of any sequence, isolated RNA of any sequence, nucleic acid probes, and primers. A polynucleotide may comprise modified nucleotides, such as methylated nucleotides and nucleotide analogs. If present, modifications to the nucleotide structure may be imparted before or after assembly of the polymer. The sequence of nucleotides may be interrupted by non-nucleotide components. A polynucleotide may be further modified after polymerization, such as by conjugation with a labeling component.

The term "complement of a polynucleotide" denotes a polynucleotide molecule having a complementary base sequence and reverse orientation as compared to a reference sequence, such that it could hybridize with a reference sequence with complete fidelity.

"Recombinant" as applied to a polynucleotide means that the polynucleotide is the product of various combinations of in vitro cloning, restriction and/or ligation steps, and other procedures that result in a construct that can potentially be expressed in a host cell.

The terms "gene" or "gene fragment" are used interchangeably herein. They refer to a polynucleotide containing at least one open reading frame that is capable of encoding a particular protein after being transcribed and translated. A gene or gene fragment may be genomic or cDNA, as long as the polynucleotide contains at least one open reading frame, which may cover the entire coding region or a segment thereof. A "fusion gene" is a gene composed of at least two heterologous polynucleotides that are linked together.

"Homology" or "homologous" refers to sequence similarity or interchangeability between two or more polynucleotide sequences or two or more polypeptide sequences. When using a program such as BestFit to determine sequence identity, similarity or homology between two different amino acid sequences, the default settings may be used, or an appropriate scoring matrix, such as blosum45 or blosum80, may be selected to optimize identity, similarity or homology scores. Preferably, polynucleotides that are homologous are those which hybridize under stringent conditions as defined herein and have at least 70%, preferably at least 80%, more preferably at least 90%, more preferably 95%, more preferably 97%, more preferably 98%, and even more preferably 99% sequence identity to those sequences.

"Ligation" refers to the process of forming phosphodiester bonds between two nucleic acid fragments or genes, linking them together. To ligate the DNA fragments or genes together, the ends of the DNA must be compatible with each other. In some cases, the ends will be directly compatible after endonuclease digestion. However, it may be necessary to first convert the staggered ends commonly produced after endonuclease digestion to blunt ends to make them compatible for ligation.

The terms "stringent conditions" or "stringent hybridization conditions" includes reference to conditions under which a polynucleotide will hybridize to its target sequence, to a detectably greater degree than other sequences (e.g., at least 2-fold over background). Generally, stringency of hybridization is expressed, in part, with reference to the temperature and salt concentration under which the wash step is carried out. Typically, stringent conditions will be those in which the salt concentration is less than about 1.5 M Na ion, typically about 0.01 to 1.0 M Na ion concentration (or other salts) at pH 7.0 to 8.3 and the temperature is at least about 30° C. for short polynucleotides (e.g., 10 to 50 nucleotides) and at least about 60° C. for long polynucleotides (e.g., greater than 50 nucleotides)—for example, "stringent conditions" can include hybridization in 50% formamide, 1 M NaCl, 1% SDS at 37° C., and three washes for 15 min each in 0.1×SSC/1% SDS at 60° C. to 65° C. Alternatively, temperatures of about 65° C., 60° C., 55° C., or 42° C. may be used. SSC concentration may be varied from about 0.1 to 2×SSC, with SDS being present at about 0.1%. Such wash temperatures are typically selected to be about 5° C. to 20° C. lower than the thermal melting point for the specific sequence at a defined ionic strength and pH. The Tm is the temperature (under defined ionic strength and pH) at which 50% of the target sequence hybridizes to a perfectly matched probe. An equation for calculating Tm and conditions for nucleic acid hybridization are well known and can be found in Sambrook, J. et al. (1989) Molecular Cloning: A Laboratory Manual, $2^{nd}$ ed., vol. 1-3, Cold Spring Harbor Press, Plainview N.Y.; specifically see volume 2 and chapter 9. Typically, blocking reagents are used to block non-specific hybridization. Such blocking reagents include, for instance, sheared and denatured salmon sperm DNA at about 100-200 µg/ml. Organic solvent, such as formamide at a concentration of about 35-50% v/v, may also be used under particular circumstances, such as for RNA: DNA hybridizations. Useful variations on these wash conditions will be readily apparent to those of ordinary skill in the art.

The terms "percent identity" and "% identity," as applied to polynucleotide sequences, refer to the percentage of residue matches between at least two polynucleotide sequences aligned using a standardized algorithm. Such an algorithm may insert, in a standardized and reproducible way, gaps in the sequences being compared in order to optimize alignment between two sequences, and therefore achieve a more meaningful comparison of the two sequences. Percent identity may be measured over the length of an entire defined polynucleotide sequence, or may be measured over a shorter length, for example, over the length of a fragment taken from a larger, defined polynucleotide sequence, for instance, a fragment of at least 45, at least 60, at least 90, at least 120, at least 150, at least 210 or at least 450 contiguous residues. Such lengths are exemplary only, and it is understood that any fragment length supported by the sequences shown herein, in the tables, figures or Sequence Listing, may be used to describe a length over which percentage identity may be measured.

"Percent (%) amino acid sequence identity," with respect to the polypeptide sequences identified herein, is defined as the percentage of amino acid residues in a query sequence that are identical with the amino acid residues of a second, reference polypeptide sequence or a portion thereof, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or Megalign (DNASTAR) software. Those skilled in the art can determine appropriate parameters for measuring alignment, including any algorithms needed to achieve maximal alignment over the full length of the sequences being compared. Percent identity may be measured over the length of an entire defined polypeptide sequence, or may be measured over a shorter length, for example, over the length of a fragment taken from a larger, defined polypeptide sequence, for instance, a fragment of at least 15, at least 20, at least 30, at least 40, at least 50, at least 70 or at least 150 contiguous residues. Such lengths are exemplary only, and it is understood that any fragment length supported by the sequences shown herein, in the tables, figures or Sequence Listing, may be used to describe a length over which percentage identity may be measured.

The term "non-repetitiveness" as used herein in the context of a polypeptide refers to a lack or limited degree of internal homology in a peptide or polypeptide sequence. The term "substantially non-repetitive" can mean, for example, that there are few or no instances of four contiguous amino acids in the sequence that are identical amino acid types or that the polypeptide has a subsequence score (defined infra) of 10 or less or that there isn't a pattern in the order, from N- to C-terminus, of the sequence motifs that constitute the polypeptide sequence. The term "repetitiveness" as used herein in the context of a polypeptide refers to the degree of internal homology in a peptide or polypeptide sequence. In contrast, a "repetitive" sequence may contain multiple identical copies of short amino acid sequences. For instance, a polypeptide sequence of interest may be divided into n-mer sequences and the number of identical sequences can be counted. Highly repetitive sequences contain a large fraction of identical sequences while non-repetitive sequences contain few identical sequences. In the context of a polypeptide, a sequence can contain multiple copies of shorter sequences of defined or variable length, or motifs, in which the motifs themselves have non-repetitive sequences, rendering the full-length polypeptide substantially non-repetitive. The length of polypeptide within which the non-repetitiveness is measured can vary from 3 amino acids to about 200 amino acids, about from 6 to about 50 amino acids, or from about 9 to about 14 amino acids. "Repetitiveness" used in the context of polynucleotide sequences refers to the degree of internal homology in the sequence such as, for example, the frequency of identical nucleotide sequences of a given length. Repetitiveness can, for example, be measured by analyzing the frequency of identical sequences.

A "vector" is a nucleic acid molecule, preferably self-replicating in an appropriate host, which transfers an inserted nucleic acid molecule into and/or between host cells. The term includes vectors that function primarily for insertion of DNA or RNA into a cell, replication of vectors that function primarily for the replication of DNA or RNA, and expression vectors that function for transcription and/or translation of the DNA or RNA. Also included are vectors that provide more than one of the above functions. An "expression vector" is a polynucleotide which, when introduced into an appropriate host cell, can be transcribed and translated into a polypeptide(s). An "expression system" usually connotes a suitable host cell comprised of an expression vector that can function to yield a desired expression product.

"Serum degradation resistance," as applied to a polypeptide, refers to the ability of the polypeptides to withstand degradation in blood or components thereof, which typically involves proteases in the serum or plasma. The serum degradation resistance can be measured by combining the protein with human (or mouse, rat, monkey, as appropriate) serum or plasma, typically for a range of days (e.g. 0.25, 0.5, 1, 2, 4, 8, 16 days), typically at about 37° C. The samples for these time points can be run on a Western blot assay and the protein is detected with an antibody. The antibody can be to a tag in the protein. If the protein shows a single band on the western, where the protein's size is identical to that of the injected protein, then no degradation has occurred. In this exemplary method, the time point where 50% of the protein is degraded, as judged by Western blots or equivalent techniques, is the serum degradation half-life or "serum half-life" of the protein.

The term "$t_{1/2}$" as used herein means the terminal half-life calculated as $\ln(2)/K_{el}$. $K_{el}$ is the terminal elimination rate constant calculated by linear regression of the terminal linear portion of the log concentration vs. time curve. Half-life typically refers to the time required for half the quantity of an administered substance deposited in a living organism to be metabolized or eliminated by normal biological processes. The terms "$t_{1/2}$", "terminal half-life", "elimination half-life" and "circulating half-life" are used interchangeably herein.

"Apparent Molecular Weight Factor" or "Apparent Molecular Weight" are related terms referring to a measure of the relative increase or decrease in apparent molecular weight exhibited by a particular amino acid sequence. The Apparent Molecular Weight is determined using size exclusion chromatography (SEC) and similar methods compared to globular protein standards and is measured in "apparent kD" units. The Apparent Molecular Weight Factor is the ratio between the Apparent Molecular Weight and the actual molecular weight; the latter predicted by adding, based on amino acid composition, the calculated molecular weight of each type of amino acid in the composition.

The "hydrodynamic radius" or "Stokes radius" is the effective radius ($R_h$ in nm) of a molecule in a solution measured by assuming that it is a body moving through the solution and resisted by the solution's viscosity. In the embodiments of the invention, the hydrodynamic radius measurements of the XTEN fusion proteins correlate with the 'Apparent Molecular Weight Factor', which is a more intuitive measure. The "hydrodynamic radius" of a protein affects its rate of diffusion in aqueous solution as well as its ability to migrate in gels of macromolecules. The hydrodynamic radius of a protein is determined by its molecular weight as well as by its structure, including shape and compactness. Methods for determining the hydrodynamic radius are well known in the art, such as by the use of size exclusion chromatography (SEC), as described in U.S. Pat. Nos. 6,406,632 and 7,294,513. Most proteins have globular structure, which is the most compact three-dimensional structure a protein can have with the smallest hydrodynamic radius. Some proteins adopt a random and open, unstructured, or 'linear' conformation and as a result have a much larger hydrodynamic radius compared to typical globular proteins of similar molecular weight.

"Physiological conditions" refer to a set of conditions in a living host as well as in vitro conditions, including temperature, salt concentration, pH, that mimic those conditions of a living subject. A host of physiologically relevant conditions for use in in vitro assays have been established. Generally, a physiological buffer contains a physiological concentration of salt and is adjusted to a neutral pH ranging from about 6.5 to about 7.8, and preferably from about 7.0 to about 7.5. A variety of physiological buffers is listed in Sambrook et al. (1989). Physiologically relevant temperature ranges from about 25° C. to about 38° C., and preferably from about 35° C. to about 37° C.

A "reactive group" is a chemical structure that can be coupled to a second reactive group. Examples for reactive groups are amino groups, carboxyl groups, sulfhydryl groups, hydroxyl groups, aldehyde groups, azide groups. Some reactive groups can be activated to facilitate coupling with a second reactive group. Non-limiting examples for activation are the reaction of a carboxyl group with carbodiimide, the conversion of a carboxyl group into an activated ester, or the conversion of a carboxyl group into an azide function.

"Controlled release agent", "slow release agent", "depot formulation" or "sustained release agent" are used interchangeably to refer to an agent capable of extending the duration of release of a polypeptide of the invention relative to the duration of release when the polypeptide is administered in the absence of agent. Different embodiments of the present invention may have different release rates, resulting in different therapeutic amounts.

The terms "antigen", "target antigen" or "immunogen" are used interchangeably herein to refer to the structure or binding determinant that an antibody fragment or an antibody fragment-based therapeutic binds to or has specificity against.

The term "payload" as used herein refers to a protein or peptide sequence that has biological or therapeutic activity; the counterpart to the pharmacophore of small molecules. Examples of payloads include, but are not limited to, cytokines, enzymes, hormones and blood and growth factors. Payloads can further comprise genetically fused or chemically conjugated moieties such as chemotherapeutic agents, antiviral compounds, toxins, or contrast agents. These conjugated moieties can be joined to the rest of the polypeptide via a linker that may be cleavable or non-cleavable.

The term "antagonist", as used herein, includes any molecule that partially or fully blocks, inhibits, or neutralizes a biological activity of a native polypeptide disclosed herein. Methods for identifying antagonists of a polypeptide may comprise contacting a native polypeptide with a candidate antagonist molecule and measuring a detectable change in one or more biological activities normally associated with the native polypeptide. In the context of the present invention, antagonists may include proteins, nucleic acids, carbohydrates, antibodies or any other molecules that decrease the effect of a biologically active protein.

The term "agonist" is used in the broadest sense and includes any molecule that mimics a biological activity of a native polypeptide disclosed herein. Suitable agonist molecules specifically include agonist antibodies or antibody fragments, fragments or amino acid sequence variants of native polypeptides, peptides, small organic molecules, etc. Methods for identifying agonists of a native polypeptide may comprise contacting a native polypeptide with a candidate agonist molecule and measuring a detectable change in one or more biological activities normally associated with the native polypeptide.

"Activity" for the purposes herein refers to an action or effect of a component of a fusion protein consistent with that of the corresponding native biologically active protein, wherein "biological activity" refers to an in vitro or in vivo biological function or effect, including but not limited to receptor binding, antagonist activity, agonist activity, or a cellular or physiologic response.

As used herein, "treatment" or "treating," or "palliating" or "ameliorating" is used interchangeably herein. These terms refer to an approach for obtaining beneficial or desired results including but not limited to a therapeutic benefit and/or a prophylactic benefit. By therapeutic benefit is meant eradication or amelioration of the underlying disorder being treated. Also, a therapeutic benefit is achieved with the eradication or amelioration of one or more of the physiological symptoms associated with the underlying disorder such that an improvement is observed in the subject, notwithstanding that the subject may still be afflicted with the underlying disorder. For prophylactic benefit, the compositions may be administered to a subject at risk of developing a particular disease, or to a subject reporting one or more of the physiological symptoms of a disease, even though a diagnosis of this disease may not have been made.

A "therapeutic effect", as used herein, refers to a physiologic effect, including but not limited to the cure, mitigation, amelioration, or prevention of disease in humans or other animals, or to otherwise enhance physical or mental wellbeing of humans or animals, caused by a fusion polypeptide of the invention other than the ability to induce the production of an antibody against an antigenic epitope possessed by the biologically active protein. Determination of a therapeutically effective amount is well within the capability of those skilled in the art, especially in light of the detailed disclosure provided herein.

The terms "therapeutically effective amount" and "therapeutically effective dose", as used herein, refers to an amount of a biologically active protein, either alone or as a part of a fusion protein composition, that is capable of having any detectable, beneficial effect on any symptom, aspect, measured parameter or characteristics of a disease state or condition when administered in one or repeated doses to a subject. Such effect need not be absolute to be beneficial.

The term "therapeutically effective dose regimen", as used herein, refers to a schedule for consecutively administered doses of a biologically active protein, either alone or as a part of a fusion protein composition, wherein the doses are given in therapeutically effective amounts to result in sustained beneficial effect on any symptom, aspect, measured parameter or characteristics of a disease state or condition.

I). General Techniques

The practice of the present invention employs, unless otherwise indicated, conventional techniques of immunology, biochemistry, chemistry, molecular biology, microbiology, cell biology, genomics and recombinant DNA, which are within the skill of the art. See Sambrook, J. et al., "Molecular Cloning: A Laboratory Manual," 3$^{rd}$ edition, Cold Spring Harbor Laboratory Press, 2001; "Current protocols in molecular biology", F. M. Ausubel, et al. eds., 1987; the series "Methods in Enzymology," Academic Press, San Diego, Calif.; "PCR 2: a practical approach", M. J. MacPherson, B. D. Hames and G. R. Taylor eds., Oxford University Press, 1995; "Antibodies, a laboratory manual" Harlow, E. and Lane, D. eds., Cold Spring Harbor Laboratory, 1988; "Goodman & Gilman's The Pharmacological Basis of Therapeutics," 11$^{th}$ Edition, McGraw-Hill, 2005; and Freshney, R. I., "Culture of Animal Cells: A Manual of Basic Technique," 4$^{th}$ edition, John Wiley & Sons, Somerset, N J, 2000, the contents of which are incorporated in their entirety herein by reference.

II). Growth Hormone

The present invention relates in part to fusion protein compositions of growth hormone (GH), including human growth hormone (hGH).

(a) Growth Hormone Proteins

"Growth Hormone" or "GH" means a growth hormone protein and species and sequence variants thereof, and includes, but is not limited to, the 191 single-chain amino acid sequence of human GH. The GH can be the native, full-length protein or can be a truncated fragment or a sequence variant that retains at least a portion of the biological activity of the native protein. There are two known types of human GH (hereinafter "hGH") derived from the pituitary gland: one having a molecular weight of about 22,000 daltons (22 kD hGH) and the other having a molecular weight of about 20,000 daltons (20 kD hGH). The 20 kD HGH has an amino acid sequence that corresponds to that of 22 kD hGH consisting of 191 amino acids except that 15 amino acid residues from the 32$^{nd}$ to the 46$^{th}$ of 22 kD hGH are missing. Some reports have shown that the 20 kD hGH has been found to exhibit lower risks and higher activity than 22 kD hGH. The invention contemplates use of the 22 kD, the 20 kD hGH, as well as species and sequence variants and truncated fragments thereof as being appropriate for use as a fusion partner with XTEN disclosed herein for GHXTEN compositions. The cloned gene for hGH has been expressed in a secreted form in *Eschericha coli* (U.S. Pat. No. 4,898, 830; Chang, C. N., et al., Gene 55:189 [1987]) and its DNA and amino acid sequence has been reported (Goeddel, et al. Nature, 281:544 [1979]; Gray, et al., Gene 39: 247[1985]).

The invention contemplates inclusion in the GHXTEN compositions sequences with homology to GH sequences, sequence fragments that are natural, such as from humans, non-human primates, mammals (including domestic animals), and non-natural sequence variants which retain at least a portion of the biologic activity or biological function of GH and/or that are useful for preventing, treating, mediating, or ameliorating a GH-related disease, deficiency, disorder or condition. Non-mammalian GH sequences are well-described in the literature. For example, a sequence alignment of fish GHs can be found in *Genetics and Molecular Biology* 2003 26 p. 295-300. An analysis of the evolution of avian GH sequences is presented in *Journal of Evolutionary Biology* 2006 19 p. 844-854. In addition, native sequences homologous to human GH may be found by standard homology searching techniques, such as NCBI BLAST.

Effects of GH on the tissues of the body can generally be described as anabolic. Like most other protein hormones, native GH acts by interacting with a specific plasma membrane receptor, referred to as growth hormone receptor. GH acts on the liver and other tissues to stimulate production of IGF-1, which is responsible for the growth promoting effects of GH and also reflects the amount produced. IGF-1, in turn, has stimulatory effects on osteoblast and chondrocyte activity to promote bone growth. In one embodiment, the invention provides a GHXTEN that exhibits at least one of the properties of native GH hereinabove described herein.

In one embodiment, the GH incorporated into the subject compositions is a recombinant polypeptide with a sequence corresponding to a protein found in nature. In another embodiment, the GH is a sequence variant, fragment, homolog, or a mimetics of a natural sequence that retains at least a portion of the biological activity of the corresponding native GH. Table 1 provides a non-limiting list of sequences of GHs from a wide variety of mammalian species that are encompassed by the GHXTEN fusion proteins of the invention. Any of these GH sequences or homologous derivatives constructed by shuffling individual mutations between species or families that retain at least a portion of the biological activity of the native GH may be useful for the fusion proteins of this invention. GH that can be incorporated into a GHXTEN fusion protein can include a protein that exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity to a sequence selected from Table 1.

TABLE 1

Growth hormone amino acid sequences from animal species

| Species GH | SEQ ID NO: | Amino Acid Sequence |
| --- | --- | --- |
| Human | 1 | FPTIPLSRLFDNAMLRAHRLHQLAFDTYQEFEEAYIPKEQKYSFLQNPQTSLCFSESIPTP SNREETQQKSNLELLRISLLLIQSWLEPVQFLRSVFANSLVYGASDSNVYDLLKDLEEGI QTLMGRLEDGSPRTGQIFKQTYSKFDTNSHNDDALLKNYGLLYCFRKDMDKVETFLRI VQCRSVEGSCGF |
| Pig | 2 | FPAMPLSSLFANAVLRAQHLHQLAADTYKEFERAYIPEGQRYSIQNAQAAFCFSETIPA PTGKDEAQQRSDVELLRFSLLLIQSWLGPVQFLSRVFTNSLVFGTSDRVYEKLKDLEEG IQALMRELEDGSPRAGQILKQTYDKFDTNLRSDDALLKNYGLLSCFKKDLHKAETYLR V MKCRRFVESSCAF |

TABLE 1-continued

Growth hormone amino acid sequences from animal species

| Species GH | SEQ ID NO: | Amino Acid Sequence |
|---|---|---|
| Alpaca | 3 | FPAMPLSSLFANAVLRAQHLHQLAADTYKEFERTYIPEGQRYSIQNAQAAFCFSETIPAP<br>TGKDEAQQRSDVELLRFSLLLIQSWLGPVQFLSRVFTNSLVFGTSDRVYEKLKDLEEGI<br>QALMRELEDGSPRAGQILRQTYDKFDTNLRSDDALLKNYGLLSCFKKDLHKAETYLR<br>V MKCRRFVESSCAF |
| Camel | 4 | FPAMPLSSLFANAVLRAQHLHQLAADTYKEFERTYIPEGQRYSIQNAQAAFCFSETIPAP<br>TGKDEAQQRSDVELLRFSLLLIQSWLGPVQFLSRVFTNSLVFGTSDRVYEKLKDLEEGI<br>QALMRELEDGSPRAGQILRQTYDKFDTNLRSDDALLKNYGLLSCFKKDLHKAETYLR<br>V MKCRRFVESSCAF |
| Horse | 5 | FPAMPLSSLFANAVLRAQHLHQLAADTYKEFERAYIPEGQRYSIQNAQAAFCFSETIPA<br>PTGKDEAQQRSDMELLRFSLLLIQSWLGPVQLLSRVFTNSLVFGTSDRVYEKLRDLEEG<br>IQALMRELEDGSPRAGQILKQTYDKFDTNLRSDDALLKNYGLLSCFKKDLHKAETYLR<br>V MKCRRFVESSCAF |
| Elephant | 6 | FPAMPLSSLFANAVLRAQHLHQLAADTYKEFERAYIPEGQRYSIQNAQAAFCFSETIPA<br>PTGKDEAQQRSDVELLRFSLLLIQSWLGPVQFLSRVFTNSLVFGTSDRVYEKLKDLEEG<br>IQALMRELEDGSPRPGQVLKQTYDKFDTNMRSDDALLKNYGLLSCFKKDLHKAETYL<br>RV MKCRRFVESSCAF |
| Red fox | 7 | FPAMPLSSLFANAVLRAQHLHQLAADTYKEFERAYIPEGQRYSIQNAQAAFCFSETIPA<br>PTGKDEAQQRSDVELLRFSLVLIQSWLGPLQFLSRVFTNSLVFGTSDRVYEKLKDLEEG<br>IQALMRELEDGSPRAGQILKQTYDKFDTNLRSDDALLKNYGLLSCFKKDLHKAETYLR<br>V MKCRRFVESSCAF |
| Dog | 8 | FPAMPLSSLFANAVLRAQHLHQLAADTYKEFERAYIPEGQRYSIQNAQAAFCFSETIPA<br>PTGKDEAQQRSDVELLRFSLLLIQSWLGPVQFLSRVFTNSLVFGTSDRVYEKLKDLEEG<br>IQALMRELEDGSPRAGQILKQTYDKFDTNLRSDDALLKNYGLLSCFKKDLHKAETYLR<br>V MKCRRFVESSCAF |
| Cat | 9 | FPAMPLSSLFANAVLRAQHLHQLAADTYKEFERAYIPEGQRYSIQNAQAAFCFSETIPA<br>PTGKDEAQQRSDVELLRFSLLLIQSWLGPVQFLSRVFTNSLVFGTSDRVYEKLKDLEEG<br>IQALMRELEDGSPRGGQILKQTYDKFDTNLRSDDALLKNYGLLSCFKKDLHKAETYLR<br>V MKCRRFVESSCAF |
| American mink | 10 | FPAMPLSSLFANAVLRAQHLHQLAADTYKDFERAYIPEGQRYSIQNAQAAFCFSETIPA<br>PTGKDEAQQRSDMELLRFSLLLIQSWLGPVQFLSRVFTNSLVFGTSDRVYEKLKDLEEG<br>IQALMRELEDGSPRAGPILKQTYDKFDTNLRSDDALLKNYGLLSCFKKDLHKAETYLR<br>V MKCRRFVESSCAF |
| Finback whale | 11 | FPAMPLSSLFANAVLRAQHLHQLAADTYKEFERAYIPEGQRYSIQNAQAAFCFSETIPA<br>PTGKDEAQQRSDVELLRFSLLLIQSWLGPVQFLSRVFTNSLVFGTSDRVYEKLKDLEEG<br>IQALMRELEDGSPRAGQILKQTYDKFDTNMRSDDALLKNYGLLSCFKKDLHKAETYLR<br>V MKCRRFVESSCAF |
| Dolphin | 12 | FPAMPLSSLFANAVLRAQHLHQLAADTYKEFERAYIPEGQRYSIQNTQAAFCFSETIPAP<br>TGKDEAQQRSDVELLRFSLLLIQSWLGPVQFLSRVFTNSLVFGTSDRVYEKLKDLEEGI<br>QALMRELEDGSPRAGQILKQTYDKFDTNMRSDDALLKNYGLLSCFKKDLHKAETYLR<br>V MKCRRFVESSCAF |
| Hippo | 13 | FPAMPLSSLFANAVLRAQHLHQLAADTYKEFERAYIPEGQRYSIQNTQAAFCFSETIPAP<br>TGKDEAQQRSDVELLRFSLLLIQSWLGPVQFLSRVFTNSLVFGTSDRVYEKLKDLEEGI<br>QALMRELEDGSPRAGQILKQTYDKFDTNMRSDDALLKNYGLLSCFKKDLHKAETYLR<br>V MKCRRFVESSCAF |
| Rabbit | 14 | FPAMPLSSLFANAVLRAQHLHQLAADTYKEFERAYIPEGQRYSIQNAQAAFCFSETIPA<br>PTGKDEAQQRSDMELLRFSLLLIQSWLGPVQFLSRAFTNTLVFGTSDRVYEKLKDLEEG<br>IQALMRELEDGSPRVGQLLKQTYDKFDTNLRGDDALLKNYGLLSCFKKDLHKAETYL<br>RV MKCRRFVESSCVF |
| Rat | 15 | FPAMPLSSLFANAVLRAQHLHQLAADTYKEFERAYIPEGQRYSIQNAQAAFCFSETIPA<br>PTGKEEAQQRTDMELLRFSLLLIQSWLGPVQFLSRIFTNSLMFGTSDRVYEKLKDLEEGI<br>QALMQELEDGSPRIGQILKQTYDKFDANMRSDDALLKNYGLLSCFKKDLHKAETYLR<br>V MKCRRFAESSCAF |
| Mouse | 16 | FPAMPLSSLFSNAVLRAQHLHQLAADTYKEFERAYIPEGQRYSIQNAQAAFCFSETIPAP<br>TGKEEAQQRTDMELLRFSLLLIQSWLGPVQFLSRIFTNSLMFGTSDRVYEKLKDLEEGI<br>QALMQELEDGSPRVGQILKQTYDKFDANMRSDDALLKNYGLLSCFKKDLHKAETYLR<br>V MKCRRFVESSCAF |
| Hamster | 17 | FPAMPLSSLFANAVLRAQHLHQLAADTYKEFERAYIPEGQRYSIQNAQTAFCFSETIPAP<br>TGKEEAQQRSDMELLRFSLLLIQSWLGPVQFLSRIFTNSLMFGTSDRVYEKLKDLEEGI<br>QALMQELEDGSPRVGQILKQTYDKFDTNMRSDDALLKNYGLLSCFKKDLHKAETYLR<br>V MKCRRFVESSCAF |

TABLE 1-continued

Growth hormone amino acid sequences from animal species

| Species GH | SEQ ID NO: | Amino Acid Sequence |
|---|---|---|
| Mole rat | 18 | FPAMPLSNLFANAVLRAQHLHQLAADTYKEFERAYIPEGQRYSIQNAQAAFCFSETIPA<br>PTGKEEAQQRSDMELLRFSLLLIQSWLGPVQFLSRVFTNSLVFGTSDRVFLKLKDLEEGI<br>QALMRELEDGSLRAGQLLKQTYDKFDTNMRSDDALLKNYGLLSCFKKDLHKAETYLR<br>V MKCRRFVESSCAF |
| Guinea pig | 19 | FPAMPLSSLFGNAVLRAQHLHQLAADTYKEFERTYIPEGQRYSIHNTQTAFCFSETIPAP<br>TDKEEAQQRSDVELLHFSLLLIQSWLGPVQFLSRVFTNSLVFGTSDRVYEKLKDLEEGI<br>QALMRELEDGTPRAGQILKQTYDKFDTNLRSNDALLKNYGLLSCFRKDLHRTETYLRV<br>MKCRRFVESSCAF |
| Ox | 20 | AFPAMSLSGLFANAVLRAQHLHQLAADTFKEFERTYIPEGQRYSIQNTQVAFCFSETIPA<br>PTGKNEAQQKSDLELLRISLLLIQSWLGPLQFLSRVFTNSLVFGTSDRVYEKLKDLEEGI<br>LALMRELEDGTPRAGQILKQTYDKFDTNMRSDDALLKNYGLLSCFRKDLHKTETYLR<br>V MKCRRFGEASCAF |
| Sheep/Goat | 21 | AFPAMSLSGLFANAVLRAQHLHQLAADTFKEFERTYIPEGQRYSIQNTQVAFCFSETIPA<br>PTGKNEAQQKSDLELLRISLLLIQSWLGPLQFLSRVFTNSLVFGTSDRVYEKLKDLEEGI<br>LALMRELEDVTPRAGQILKQTYDKFDTNMRSDDALLKNYGLLSCFRKDLHKTETYLR<br>V MKCRRFGEASCAF |
| Red deer | 22 | FPAMSLSGLFANAVLRAQHLHQLAADTFKEFERTYIPEGQRYSIQNTQVAFCFSETIPAP<br>TGKNEAQQKSDLELLRISLLLIQSWLGPLQFLSRVFTNSLVFGTSDRVYEKLKDLEEGIL<br>ALMRELEDGTPRAGQILKQTYDKFDTNMRSDDALLKNYGLLSCFRKDLHKTETYLRV<br>MKCRRFGEASCAF |
| Giraffe | 23 | AFPAMSLSGLFANAVLRAQHLHQLAADTFKEFERTYIPEGQRYSIQNTQVAFCFSETIPA<br>PTGKNEAQQKSDLELLRISLLLIQSWLGPLQFLSRVFSNSLVFGTSDRVYEKLKDLEEGI<br>LALMRELEDGTPRAGQILKQTYDKFDTNMRSDDALLKNYGLLSCFRKDLHKTETYLR<br>V MKCRRFGEASCAF |
| Chevrotain-1 | 24 | FPAMSLSGLFANAVLRVQHLHQLAADTFKEFERTYIPEGQRYSIQNTQVAFCFSETIPAP<br>TGKNEAQQKSDLELLRISLLLIQSWLGPLQFLSRVFTNSLVFGTSDRVYEKLKDLEEGIL<br>ALMRELEDGPPRAGQILKQTYDKFDTNMRSDDALLKNYGLLSCFRKDLHKTETYLRV<br>MKCRRFGEASCAF |
| Slow loris | 25 | FPAMPLSSLFANAVLRAQHLHQLAADTYKEFERAYIPEGQRYSIQNAQAAFCFSETIPA<br>PTGKDEAQQRSDMELLRFSLLLIQSWLGPVQLLSRVFTNSLVLGTSDRVYEKLKDLEEG<br>IQALMRELEDGSPRVGQILKQTYDKFDTNLRSDDALLKNYGLLSCFKKDLHKAETYLR<br>V MKCRRFVESSCAF |
| Marmoset | 26 | FPTIPLSRLLDNAMLRAHRLHQLAFDTYQEFEEAYIPKEQKYSFLQNPQTSLCFSESIPTP<br>ASKKETQQKSNLELLRMSLLLIQSWFEPVQFLRSVFANSLLYGVSDSDVYEYLKDLEEG<br>IQTLMGRLEDGSPRTGEIFMQTYRKFDVNSQNNDALLKNYGLLYCFRKDMDKVETFL<br>RI VQCR-SVEGSCGF |
| BrTailed Possum | 27 | FPAMPLSSLFANAVLRAQHLHQLVADTYKEFERTYIPEAQRHSIQSTQTAFCFSETIPAP<br>TGKDEAQQRSDVELLRFSLLLIQSWLSPVQFLSRVFTNSLVFGTSDRVYEKLRDLEEGIQ<br>ALMQELEDGSSRGGLVLKTTYDKFDTNLRSDEALLKNYGLLSCFKKDLHKAETYLRV<br>MKCRRFVESSCAF |
| Monkey (rhesus) | 28 | FPTIPLSRLFDNAMLRAHRLHQLAFDTYQEFEEAYIPKEQKYSFLQNPQTSLCFSESIPTP<br>SNREETQQKSNLELLRISLLLIQSWLEPVQFLRSVFANSLVYGTSYSDVYDLLKDLEEGI<br>QTLMGRLEDGSSRTGQIFKQTYSKFDTNSHNNDALLKNYGLLYCFRKDMDKIETFLRI<br>VQCR-SVEGSCGF |

III). Growth Hormone Fusion Protein Compositions

The present invention relates in part to fusion protein compositions of growth hormone (GH). In one aspect, the invention provides isolated monomeric fusion proteins of GH comprising the full-length sequence or sequence variants of GH covalently linked to extended recombinant recombinant polypeptides ("XTEN" or "XTENs"). As described more fully below, the fusion proteins optionally include spacer sequences that further comprise cleavage sequences to release the GH from the fusion protein when acted on by a protease, releasing GH from the XTEN sequence(s).

In one aspect, the invention provides an isolated fusion protein comprising at least a first biologically active growth hormone protein covalently linked to one or more extended recombinant polypeptides ("XTEN"), resulting in a growth hormone-XTEN fusion protein composition (hereinafter "GHXTEN"). In one embodiment, the growth hormone is human growth hormone or a sequence variant of hGH. As described more fully below, the fusion proteins optionally include spacer sequences that further comprise cleavage sequences to release the GH from the fusion protein when acted on by a protease.

The term "GHXTEN", as used herein, is meant to encompass fusion polypeptides that comprise one or more payload regions each comprising a biologically active GH that mediates one or more biological or therapeutic activities associated with growth hormone and at least one other region comprising at least a first XTEN polypeptide that serves as a carrier.

The GH of the subject compositions, particularly those disclosed in Table 1, together with their corresponding nucleic acid and amino acid sequences, are well known in the art and descriptions and sequences are available in public databases such as Chemical Abstracts Services Databases (e.g., the CAS Registry), GenBank, The Universal Protein Resource (UniProt) and subscription provided databases such as GenSeq (e.g., Derwent). Polynucleotide sequences may be a wild type polynucleotide sequence encoding a given GH (e.g., either full length or mature), or in some instances the sequence may be a variant of the wild type polynucleotide sequence (e.g., a polynucleotide which encodes the wild type biologically active protein, wherein the DNA sequence of the polynucleotide has been optimized, for example, for expression in a particular species; or a polynucleotide encoding a variant of the wild type protein, such as a site directed mutant or an allelic variant. It is well within the ability of the skilled artisan to use a wild-type or consensus cDNA sequence or a codon-optimized variant of a GH to create GHXTEN constructs contemplated by the invention using methods known in the art and/or in conjunction with the guidance and methods provided herein, and described more fully in the Examples.

The GH for inclusion in the GHXTEN of the invention include any growth hormone or sequence variant of biologic, therapeutic, prophylactic, or diagnostic interest or function, or that is useful for mediating or preventing or ameliorating a disease, disorder or condition associated with growth, growth hormone deficiency or defect when administered to a subject. Of particular interest are GHXTEN fusion protein compositions for which an increase in a pharmacokinetic parameter, increased solubility, increased stability, or some other enhanced pharmaceutical property compared to native GH is sought, or for which increasing the terminal half-life would improve efficacy, safety, or result in reduce dosing frequency and/or improve patient compliance. Thus, the GHXTEN fusion protein compositions are prepared with various objectives in mind, including improving the therapeutic efficacy of the bioactive GH by, for example, increasing the in vivo exposure or the length that the GHXTEN remains within the therapeutic window when administered to a subject, compared to a GH not linked to XTEN.

In one embodiment, the GH incorporated into the subject compositions can be a recombinant polypeptide with a sequence corresponding to a protein found in nature. In another embodiment, the GH is a sequence variant, fragment, homolog, or mimetic of a natural sequence that retain at least a portion of the biological activity of the native GH. In non-limiting examples, a GH is a sequence that exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, or at least about 99%, or 100% sequence identity to a protein sequence selected from Table 1. In one embodiment, a GHXTEN fusion protein comprises a single GH molecule linked to an XTEN (as described more fully below). In another embodiment, the GHXTEN comprises a first GH and a second molecule of the same GH, resulting in a fusion protein comprising the two GH linked to one or more XTEN (for example, or two molecules of hGH). In some cases of the foregoing embodiments, the GH and XTEN components are of an N- to C-terminus configuration selected from Table 5. In another embodiment, the GHXTEN fusion protein comprises a single GH molecule linked to a first and a second XTEN, with an N- to C-terminus configuration of XTEN-GH-XTEN, in which the GH is a sequence that exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, or at least about 99%, or 100% sequence identity to a protein sequence selected from Table 1, and the first and/or the second XTEN are sequences that exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, or at least about 99%, or 100% sequence identity to a sequence selected from Table 3.

In general, the GH fusion partner component of the GHXTEN exhibits a binding specificity to a given target or another desired biological characteristic when used in vivo or when utilized in an in vitro assay. For example, the GHXTEN is an agonist, having the ability to bind to a transmembrane receptor for growth hormone. In one embodiment, the binding of GHXTEN to growth receptor leads to receptor dimerization and lead to at least a portion of the activation of intercellular signal transduction pathway compared to native growth hormone. In one embodiment, the GHXTEN bound to a transmembrane receptor for growth hormone would exhibit at least about 1%, or about 5%, or about 10%, or about 15%, or about 20%, or about 25%, or about 30%, or about 40%, or about 50%, or about 60%, or about 70%, or about 80%, or about 90%, or at least about 95% of the activation of intercellular signal transduction pathway compared to native growth hormone not linked to XTEN.

The subject GHXTEN of the present invention exhibits an enhancement of one or more pharmacokinetic parameters, which optionally is enhanced by release of GH from the fusion protein by cleavage of a spacer sequence. The GHXTEN with enhanced pharmacokinetic parameters permits less frequent dosing or an enhanced pharmacologic effect, such as but not limited to maintaining the biologically active GHXTEN within the therapeutic window between the minimum effective dose or blood concentration ($C_{min}$) and the maximum tolerated dose or blood concentration ($C_{max}$). In such cases, the linking of the GH to a fusion protein comprising a select XTEN sequence(s) can result in an improvement in these properties, making them more useful as therapeutic or preventive agents compared to GH not linked to XTEN.

IV). Extended Recombinant Polypeptides

In one aspect, the invention provides XTEN polypeptide compositions that are useful as a fusion protein partner to which GH is linked, resulting in a GHXTEN fusion protein. XTEN are generally extended length polypeptides with non-naturally occurring, substantially non-repetitive sequences that are composed mainly of small hydrophilic amino acids, with the sequence having a low degree or no secondary or tertiary structure under physiologic conditions. XTENs have utility as a fusion protein partners partner in that they serve as a "carrier", conferring certain desirable pharmacokinetic, physicochemical and pharmaceutical properties when linked to a GH protein to a create a fusion protein. Such desirable properties include but are not limited to enhanced pharmacokinetic parameters and solubility characteristics the compositions, amongst other properties described herein. Such fusion protein compositions have utility to treat certain growth hormone-related diseases, disorders or conditions, as described herein. As used herein, "XTEN" specifically excludes antibodies or antibody fragments such as single-chain antibodies or Fc fragments of a light chain or a heavy chain.

In some embodiments, XTEN are long polypeptides having greater than about 100 to about 3000 amino acid residues, preferably greater than 400 to about 3000 residues when used as a carrier or cumulatively when more than one XTEN unit is used in a single fusion protein. In other embodiments, when used as a linker between fusion protein components or where an increase in half-life of the fusion protein is not needed but where an increase in solubility or other physico/chemical property for the GH fusion partner component is desired, an XTEN sequence shorter than 100 amino acid residues, such as about 96, or about 84, or about 72, or about 60, or about 48, or about 36 amino acid residues are incorporated into a fusion protein composition with the GH to effect the property.

The selection criteria for the XTEN to be linked to the biologically active proteins used to create the inventive fusion proteins compositions generally relate to attributes of physical/chemical properties and conformational structure of the XTEN that is, in turn, used to confer enhanced pharmaceutical and pharmacokinetic properties to the fusion proteins compositions. The XTEN of the present invention exhibit one or more of the following advantageous properties: conformational flexibility, enhanced aqueous solubility, high degree of protease resistance, low immunogenicity, low binding to mammalian receptors, and increased hydrodynamic (or Stokes) radii; properties that make them particularly useful as fusion protein partners. Non-limiting examples of the properties of the fusion proteins comprising GH that is enhanced by XTEN include increases in the overall solubility and/or metabolic stability, reduced susceptibility to proteolysis, reduced immunogenicity, reduced rate of absorption when administered subcutaneously or intramuscularly, and enhanced pharmacokinetic properties such as longer terminal half-life and increased area under the curve (AUC), slower absorption after subcutaneous or intramuscular injection (compared to GH not linked to XTEN and administered by a similar route) such that the $C_{max}$ is lower, which, in turn, results in reductions in adverse effects of the GH that, collectively, results in an increased period of time that a fusion protein of a GHXTEN composition administered to a subject retains therapeutic activity.

A variety of methods and assays are known in the art for determining the physical/chemical properties of proteins such as the compositions comprising the inventive XTEN; properties such as secondary or tertiary structure, solubility, protein aggregation, melting properties, contamination and water content. Such methods include analytical centrifugation, EPR, HPLC-ion exchange, HPLC-size exclusion, HPLC-reverse phase, light scattering, capillary electrophoresis, circular dichroism, differential scanning calorimetry, fluorescence, HPLC-ion exchange, HPLC-size exclusion, IR, NMR, Raman spectroscopy, refractometry, and UV/Visible spectroscopy. Additional methods are disclosed in Arnau et al, Prot Expr and Purif (2006) 48, 1-13. Application of these methods to the invention would be within the grasp of a person skilled in the art.

Typically, XTEN are designed to behave like denatured peptide sequences under physiological conditions, despite the extended length of the polymer. Denatured describes the state of a peptide in solution that is characterized by a large conformational freedom of the peptide backbone. Most peptides and proteins adopt a denatured conformation in the presence of high concentrations of denaturants or at elevated temperature. Peptides in denatured conformation have, for example, characteristic circular dichroism (CD) spectra and are characterized by a lack of long-range interactions as determined by NMR. "Denatured conformation" and "unstructured conformation" are used synonymously herein. In some embodiments, the invention provides XTEN sequences that, under physiologic conditions, resemble denatured sequences largely devoid in secondary structure. In other cases, the XTEN sequences are substantially devoid of secondary structure under physiologic conditions. "Largely devoid," as used in this context, means that less than 50% of the XTEN amino acid residues of the XTEN sequence contribute to secondary structure as measured or determined by the means described herein. "Substantially devoid," as used in this context, means that at least about 60%, or about 70%, or about 80%, or about 90%, or about 95%, or at least about 99% of the XTEN amino acid residues of the XTEN sequence do not contribute to secondary structure, as measured or determined by the methods described herein.

A variety of methods have been established in the art to discern the presence or absence of secondary and tertiary structures in a given polypeptide. In particular, secondary structure can be measured spectrophotometrically, e.g., by circular dichroism spectroscopy in the "far-UV" spectral region (190-250 nm). Secondary structure elements, such as alpha-helix and beta-sheet, each give rise to a characteristic shape and magnitude of CD spectra. Secondary structure can also be predicted for a polypeptide sequence via certain computer programs or algorithms, such as the well-known Chou-Fasman algorithm (Chou, P. Y., et al. (1974) *Biochemistry*, 13: 222-45) and the Garnier-Osguthorpe-Robson ("GOR") algorithm (Garnier J, Gibrat J F, Robson B. (1996), GOR method for predicting protein secondary structure from amino acid sequence. Methods Enzymol 266:540-553), as described in US Patent Application Publication No. 20030228309A1. For a given sequence, the algorithms can predict whether there exists some or no secondary structure at all, expressed as the total and/or percentage of residues of the sequence that form, for example, alpha-helices or beta-sheets or the percentage of residues of the sequence predicted to result in random coil formation (which lacks secondary structure).

In some embodiments, the XTEN sequences used in the inventive fusion protein compositions can have an alpha-helix percentage ranging from 0% to less than about 5% as determined by the Chou-Fasman algorithm. In other cases, the XTEN sequences of the fusion protein compositions have a beta-sheet percentage ranging from 0% to less than about 5% as determined by the Chou-Fasman algorithm. In some embodiments, the XTEN sequences of the fusion protein compositions have an alpha-helix percentage ranging from 0% to less than about 5% and a beta-sheet percentage ranging from 0% to less than about 5% as determined by the Chou-Fasman algorithm. In some embodiments, the XTEN sequences of the fusion protein compositions have an alpha-helix percentage less than about 2% and a beta-sheet percentage less than about 2%. In other cases, the XTEN sequences of the fusion protein compositions have a high degree of random coil percentage, as determined by the GOR algorithm. In some embodiments, an XTEN sequence have at least about 80%, more preferably at least about 90%, more preferably at least about 91%, more preferably at least about 92%, more preferably at least about 93%, more preferably at least about 94%, more preferably at least about 95%, more preferably at least about 96%, more preferably at least about 97%, more preferably at least about 98%, and most preferably at least about 99% random coil, as determined by the GOR algorithm.

1. Non-Repetitive Sequences

In some embodiments, XTEN sequences of the compositions are substantially non-repetitive. In general, repetitive amino acid sequences have a tendency to aggregate or form higher order structures, as exemplified by natural repetitive sequences such as collagens and leucine zippers, or form contacts resulting in crystalline or pseudocrystaline structures. In contrast, the low tendency of non-repetitive sequences to aggregate enables the design of long-sequence XTENs with a relatively low frequency of charged amino acids that would be likely to aggregate if the sequences were otherwise repetitive. Typically, the GHXTEN fusion proteins comprise XTEN sequences of greater than about 100 to about 3000 amino acid residues, preferably greater than 400 to about 3000 cumulative residues, wherein the sequences are substantially non-repetitive. In one embodiment, the XTEN sequences have greater than about 100 to about 3000 amino acid residues, preferably greater than 400 to about 3000 amino acid residues, in which no three contiguous amino acids in the sequence are identical amino acid types unless the amino acid is serine, in which case no more than three contiguous amino acids are serine residues. In the foregoing embodiment, the XTEN sequence would be substantially non-repetitive.

The degree of repetitiveness of a polypeptide or a gene are measured by computer programs or algorithms or by other means known in the art. Repetitiveness in a polypeptide sequence can, for example, be assessed by determining the number of times shorter sequences of a given length occur within the polypeptide. For example, a polypeptide of 200 amino acid residues has 192 overlapping 9-amino acid sequences (or 9-mer "frames") and 198 3-mer frames, but the number of unique 9-mer or 3-mer sequences will depend on the amount of repetitiveness within the sequence. A score is generated (hereinafter "subsequence score") that is reflective of the degree of repetitiveness of the subsequences in the overall polypeptide sequence. In the context of the present invention, "subsequence score" means the sum of occurrences of each unique 3-mer frame across a 200 consecutive amino acid sequence of the polypeptide divided by the absolute number of unique 3-mer subsequences within the 200 amino acid sequence. Examples of such subsequence scores derived from the first 200 amino acids of repetitive and non-repetitive polypeptides are presented in Example 44. In some embodiments, the present invention provides GHXTEN each comprising one or more XTEN in which the XTEN have a subsequence score less than 12, more preferably less than 10, more preferably less than 9, more preferably less than 8, more preferably less than 7, more preferably less than 6, and most preferably less than 5. In the embodiments hereinabove described in this paragraph, an XTEN with a subsequence score less than about 10 (i.e., 9, 8, 7, etc.) is "substantially non-repetitive."

The non-repetitive characteristic of XTEN impart to fusion proteins with GH a greater degree of solubility and less tendency to aggregate compared to polypeptides having repetitive sequences. These properties facilitate the formulation of XTEN-comprising pharmaceutical preparations containing extremely high drug concentrations, in some cases exceeding 100 mg/ml.

Furthermore, the XTEN polypeptide sequences of the embodiments are designed to have a low degree of internal repetitiveness in order to reduce or substantially eliminate immunogenicity when administered to a mammal Polypeptide sequences composed of short, repeated motifs largely limited to three amino acids, such as glycine, serine and glutamate, may result in relatively high antibody titers when administered to a mammal despite the absence of predicted T-cell epitopes in these sequences. This may be caused by the repetitive nature of polypeptides, as it has been shown that immunogens with repeated epitopes, including protein aggregates, cross-linked immunogens, and repetitive carbohydrates are highly immunogenic and can, for example, result in the cross-linking of B-cell receptors causing B-cell activation. (Johansson, J., et al. (2007) Vaccine, 25:1676-82; Yankai, Z., et al. (2006) Biochem Biophys Res Commun, 345:1365-71; Hsu, C. T., et al. (2000) Cancer Res, 60:3701-5); Bachmann M F, et al. Eur J Immunol. (1995) 25(12): 3445-3451).

2. Exemplary Sequence Motifs

The present invention encompasses XTEN that comprise multiple units of shorter sequences, or motifs, in which the amino acid sequences of the motifs are non-repetitive. In designing XTEN sequences, it was discovered that the non-repetitive criterion may be met despite the use of a "building block" approach using a library of sequence motifs that are multimerized to create the XTEN sequences. Thus, while an XTEN sequence may consist of multiple units of as few as four different types of sequence motifs, because the motifs themselves generally consist of non-repetitive amino acid sequences, the overall XTEN sequence is rendered substantially non-repetitive.

In one embodiment, XTEN have a non-repetitive sequence of greater than about 100 to about 3000 amino acid residues, preferably greater than 400 to about 3000 residues, wherein at least about 80%, or at least about 85%, or at least about 90%, or at least about 95%, or at least about 97%, or about 100% of the XTEN sequence consists of non-overlapping sequence motifs, wherein each of the motifs has about 9 to 36 amino acid residues. In other embodiments, at least about 80%, or at least about 85%, or at least about 90%, or at least about 95%, or at least about 97%, or about 100% of the XTEN sequence consists of non-overlapping sequence motifs wherein each of the motifs has 9 to 14 amino acid residues. In still other embodiments, at least about 80%, or at least about 85%, or at least about 90%, or at least about 95%, or at least about 97%, or about 100% of the XTEN sequence component consists of non-overlapping sequence motifs wherein each of the motifs has 12 amino acid residues. In these embodiments, it is preferred that the sequence motifs be composed mainly of small hydrophilic amino acids, such that the overall sequence has an unstructured, flexible characteristic. Examples of amino acids that are included in XTEN, are, e.g., arginine, lysine, threonine, alanine, asparagine, glutamine, aspartate, glutamate, serine, and glycine. As a result of testing variables such as codon optimization, assembly polynucleotides encoding sequence motifs, expression of protein, charge distribution and solubility of expressed protein, and secondary and tertiary structure, it was discovered that XTEN compositions with enhanced characteristics mainly include glycine (G), alanine (A), serine (S), threonine (T), glutamate (E) and proline (P) residues wherein the sequences are designed to be substantially non-repetitive. In one embodiment, XTEN sequences have predominately four to six types of amino acids selected from glycine (G), alanine (A), serine (S), threonine (T), glutamate (E) or proline (P) that are arranged in a substantially non-repetitive sequence that is greater than about 100 to about 3000 amino acid residues, preferably greater than 400 to about 3000 residues in length. In some embodiments, XTEN have sequences of greater than about 100 to about 3000 amino acid residues, preferably greater than 400 to about 3000 residues, wherein at least about 80% of the sequence consists of non-overlapping sequence motifs wherein each of the motifs has 9 to 36 amino acid residues wherein each of the motifs consists of 4 to 6 types of amino acids selected from glycine (G), alanine (A), serine (S), threonine (T), glutamate (E) and proline (P), and wherein the content of any one amino acid type in the full-length XTEN does not exceed 30%. In other embodiments, at least about 90% of the XTEN sequence consists of non-overlapping sequence motifs wherein each of the motifs has 9 to 36 amino acid residues wherein the motifs consist of 4 to 6 types of amino acids selected from glycine (G), alanine (A), serine (S), threonine (T), glutamate (E) and proline (P), and wherein the content of any one amino acid type in the full-length XTEN does not exceed 30%. In other embodiments, at least about 90% of the XTEN sequence consists of non-overlapping sequence motifs wherein each of the motifs has 12 amino acid residues consisting of 4 to 6 types of amino acids selected from glycine (G), alanine (A), serine (S), threonine (T), glutamate (E) and proline (P), and wherein the content of any one amino acid type in the full-length XTEN does not exceed 30%. In yet other embodiments, at least about 90%, or about 91%, or about 92%, or about 93%, or about 94%, or about 95%, or about 96%, or about 97%, or about 98%, or about 99%, to about 100% of the XTEN sequence consists of non-overlapping sequence motifs wherein each of the motifs has 12 amino acid residues consisting of glycine (G), alanine (A), serine (S), threonine (T), glutamate (E) and proline (P), and wherein the content of any one amino acid type in the full-length XTEN does not exceed 30%.

In still other embodiments, XTENs comprise non-repetitive sequences of greater than about 100 to about 3000 amino acid residues, preferably greater than 400 to about 3000 amino acid residues wherein at least about 80%, or at least about 90%, or about 91%, or about 92%, or about 93%, or about 94%, or about 95%, or about 96%, or about 97%, or about 98%, or about 99% of the sequence consists of non-overlapping sequence motifs of 9 to 14 amino acid residues wherein the motifs consist of 4 to 6 types of amino acids selected from glycine (G), alanine (A), serine (S), threonine (T), glutamate (E) and proline (P), and wherein the sequence of any two contiguous amino acid residues in any one motif is not repeated more than twice in the sequence motif. In other embodiments, at least about 90%, or about 91%, or about 92%, or about 93%, or about 94%, or about 95%, or about 96%, or about 97%, or about 98%, or about 99% of an XTEN sequence consists of non-overlapping sequence motifs of 12 amino acid residues wherein the motifs consist of 4 to 6 types of amino acids selected from glycine (G), alanine (A), serine (S), threonine (T), glutamate (E) and proline (P), and wherein the sequence of any two contiguous amino acid residues in any one sequence motif is not repeated more than twice in the sequence motif. In other embodiments, at least about 90%, or about 91%, or about 92%, or about 93%, or about 94%, or about 95%, or about 96%, or about 97%, or about 98%, or about 99% of an XTEN sequence consists of non-overlapping sequence motifs of 12 amino acid residues wherein the motifs consist of glycine (G), alanine (A), serine (S), threonine (T), glutamate (E) and proline (P), and wherein the sequence of any two contiguous amino acid residues in any one sequence motif is not repeated more than twice in the sequence motif. In yet other embodiments, XTENs consist of 12 amino acid sequence motifs wherein the amino acids are selected from glycine (G), alanine (A), serine (S), threonine (T), glutamate (E) and proline (P), and wherein the sequence of any two contiguous amino acid residues in any one sequence motif is not repeated more than twice in the sequence motif, and wherein the content of any one amino acid type in the full-length XTEN does not exceed 30%. In the foregoing embodiments hereinabove described in this paragraph, the XTEN sequences would be substantially non-repetitive.

In some embodiments, the invention provides compositions comprising non-repetitive XTEN sequence(s) of greater than about 100 to about 3000 amino acid residues, of cumulatively greater than 400 to about 3000 residues, wherein at least about 80%, or at least about 90%, or about 91%, or about 92%, or about 93%, or about 94%, or about 95%, or about 96%, or about 97%, or about 98%, or about 99% to about 100% of the sequence consists of multiple units of two or more non-overlapping sequence motifs selected from the amino acid sequences of Table 2. In some embodiments, the XTEN comprises non-overlapping sequence motifs in which about 80%, or at least about 90%, or about 91%, or about 92%, or about 93%, or about 94%, or about 95%, or about 96%, or about 97%, or about 98%, or about 99% to about 100% of the sequence consists of two or more non-overlapping sequences selected from a single motif family of Table 2, resulting in a "family" sequence in which the overall sequence remains substantially non-repetitive. Accordingly, in these embodiments, an XTEN sequence comprises multiple units of non-overlapping sequence motifs of the AD motif family, or the AE motif family, or the AF motif family, or the AG motif family, or the AM motif family, or the AQ motif family, or the BC family, or the BD family of sequences of Table 2. In other embodiments, the XTEN comprises motif sequences from two or more of the motif families of Table 2.

TABLE 2

XTEN Sequence Motifs of 12 Amino Acids and Motif Families

| Motif Family* | SEQ ID NO: | MOTIF SEQUENCE |
|---|---|---|
| AD | 29 | GESPGGSSGSES |
| AD | 30 | GSEGSSGPGESS |
| AD | 31 | GSSESGSSEGGP |
| AD | 32 | GSGGEPSESGSS |
| AE, AM | 33 | GSPAGSPTSTEE |
| AE, AM, AQ | 34 | GSEPATSGSETP |
| AE, AM, AQ | 35 | GTSESATPESGP |
| AE, AM, AQ | 36 | GTSTEPSEGSAP |
| AF, AM | 37 | GSTSESPSGTAP |
| AF, AM | 38 | GTSTPESGSASP |
| AF, AM | 39 | GTSPSGESSTAP |
| AF, AM | 40 | GSTSSTAESPGP |
| AG, AM | 41 | GTPGSGTASSSP |
| AG, AM | 42 | GSSTPSGATGSP |
| AG, AM | 43 | GSSPSASTGTGP |
| AG, AM | 44 | GASPGTSSTGSP |
| AQ | 45 | GEPAGSPTSTSE |
| AQ | 46 | GTGEPSSTPASE |
| AQ | 47 | GSGPSTESAPTE |
| AQ | 48 | GSETPSGPSETA |
| AQ | 49 | GPSETSTSEPGA |

TABLE 2-continued

XTEN Sequence Motifs of 12 Amino Acids and Motif Families

| Motif Family* | SEQ ID NO: | MOTIF SEQUENCE |
|---|---|---|
| AQ | 50 | GSPSEPTEGTSA |
| BC | 51 | GSGASEPTSTEP |
| BC | 52 | GSEPATSGTEPS |
| BC | 53 | GTSEPSTSEPGA |
| BC | 54 | GTSTEPSEPGSA |
| BD | 55 | GSTAGSETSTEA |
| BD | 56 | GSETATSGSETA |
| BD | 57 | GTSESATSESGA |
| BD | 58 | GTSTEASEGSAS |

*Denotes individual motif sequences that, when used together in various permutations, results in a "family sequence"

In other embodiments, the GHXTEN composition comprises a non-repetitive XTEN sequence of greater than about 100 to about 3000 amino acid residues, preferably greater than 400 to about 3000 residues, wherein at least about 80%, or at least about 90%, or about 91%, or about 92%, or about 93%, or about 94%, or about 95%, or about 96%, or about 97%, or about 98%, or about 99% to about 100% of the sequence consists of non-overlapping 36 amino acid sequence motifs selected from one or more of the polypeptide sequences of Tables 8-11.

In those embodiments wherein the XTEN component of the GHXTEN fusion protein has less than 100% of its amino acids consisting of four to six amino acid selected from glycine (G), alanine (A), serine (S), threonine (T), glutamate (E) and proline (P), or less than 100% of the sequence consisting of the sequence motifs of Table 2, or less than 100% sequence identity with an XTEN from Table 3, the other amino acid residues are selected from any other of the 14 natural L-amino acids, but are preferentially selected from hydrophilic amino acids such that the XTEN sequence contains at least about 90%, or at least about 91%, or at least about 92%, or at least about 93%, or at least about 94%, or at least about 95%, or at least about 96%, or at least about 97%, or at least about 98%, or at least about 99% hydrophilic amino acids. The XTEN amino acids that are not glycine (G), alanine (A), serine (S), threonine (T), glutamate (E) and proline (P) are interspersed throughout the XTEN sequence, are located within or between the sequence motifs, or are concentrated in one or more short stretches of the XTEN sequence. In such cases where the XTEN component of the GHXTEN comprises amino acids other than glycine (G), alanine (A), serine (S), threonine (T), glutamate (E) and proline (P), it is preferred that the amino acids not be hydrophobic residues and should not substantially confer secondary structure of the XTEN component. Hydrophobic residues that are less favored in construction of XTEN include tryptophan, phenylalanine, tyrosine, leucine, isoleucine, valine, and methionine. Additionally, one can design the XTEN sequences to contain few (e.g. less than 5%) or none of the following amino acids: cysteine (to avoid disulfide formation and oxidation), methionine (to avoid oxidation), asparagine and glutamine (to avoid desamidation). Thus, in some embodiments, the XTEN component of the GHXTEN fusion protein comprising other amino acids in addition to glycine (G), alanine (A), serine (S), threonine (T), glutamate (E) and proline (P) would have a sequence with less than 5% of the residues contributing to alpha-helices and beta-sheets as measured by the Chou-Fasman algorithm and have at least 90%, or at least about 95% or more random coil formation as measured by the GOR algorithm.

3. Length of Sequence

In another aspect of the present invention, the invention encompasses GHXTEN compositions comprising carriers of XTEN polypeptides with extended length sequences. The present invention makes use of the discovery that increasing the length of non-repetitive, unstructured polypeptides enhances the unstructured nature of the XTENs and correspondingly enhances the biological and pharmacokinetic properties of fusion proteins comprising the XTEN carrier. As described more fully in the Examples, proportional increases in the length of the XTEN, even if created by a fixed repeat order of single family sequence motifs (e.g., the four AE motifs of Table 2), result in a sequence with a higher percentage of random coil formation, as determined by GOR algorithm, compared to shorter XTEN lengths. In general, increasing the length of the unstructured polypeptide fusion partner, as described in the Examples, results in a fusion protein with a disproportional increase in terminal half-life compared to fusion proteins with unstructured polypeptide partners with shorter sequence lengths.

Non-limiting examples of XTEN contemplated for inclusion in the GHXTEN of the invention are presented in Table 3. In one embodiment, the invention provides GHXTEN compositions wherein the XTEN sequence length of the fusion protein(s) is greater than about 100 to about 3000 amino acid residues, and in some cases is greater than 400 to about 3000 amino acid residues, wherein the XTEN confers enhanced pharmacokinetic properties on the GHXTEN in comparison to GH not linked to XTEN. In some embodiments, the XTEN sequences of the GHXTEN compositions of the present invention can be about 100, or about 144, or about 288, or about 401, or about 500, or about 600, or about 700, or about 800, or about 900, or about 1000, or about 1500, or about 2000, or about 2500 or up to about 3000 amino acid residues in length. In other cases, the XTEN sequences can be about 100 to 150, about 150 to 250, about 250 to 400, 401 to about 500, about 500 to 900, about 900 to 1500, about 1500 to 2000, or about 2000 to about 3000 amino acid residues in length. In one embodiment, the GHXTEN can comprise an XTEN sequence wherein the sequence exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity to a XTEN selected from Table 3. In some embodiments, the XTEN sequence is designed for optimized expression as the N-terminal component of the GHXTEN by inclusion of encoding nucleotides for an optimized N-terminal leader sequence (NTS) in the XTEN portion of the gene encoding the fusion protein. In one embodiment, the N-terminal XTEN sequence of the expressed GHXTEN has at least 90% sequence identity to the sequence of AE48 or AM48, AE624, or AE912 or AM923. In another embodiment, the XTEN has the N-terminal residues described in Examples 14-17.

In other embodiments, the GHXTEN fusion protein comprises a first and a second XTEN sequence, wherein the cumulative total of the residues in the XTEN sequences is greater than about 400 to about 3000 amino acid residues. In embodiments of the foregoing, the GHXTEN fusion protein comprises a first and a second XTEN sequence wherein the sequences each exhibit at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity to at least a first or additionally a second XTEN selected from Table 3. Examples where more than one XTEN is used in a GHXTEN composition include, but are not limited to constructs with an XTEN linked to both the N- and C-termini of at least one GH.

As described more fully below, the invention provides methods in which the GHXTEN is designed by selecting the length of the XTEN to confer a target half-life on a fusion protein administered to a subject. In general, XTEN lengths longer that about cumulative 400 residues incorporated into the GHXTEN compositions result in longer half-life compared to shorter cumulative lengths; e.g., shorter than about 280 residues. However, in another embodiment, GHXTEN fusion proteins are designed to comprise XTEN with a longer sequence length that is selected to additionally confer slower rates of systemic absorption after subcutaneous or intramuscular administration to a subject. In such embodiments, the $C_{max}$ is reduced in comparison to a comparable dose of a GH not linked to XTEN, thereby contributing to the ability to keep the GHXTEN within the therapeutic window for the composition. Thus, the XTEN confers the property of a depot to the administered GHXTEN, in addition to the other physical/chemical properties described herein.

TABLE 3

XTEN Polypeptides

| XTEN Name | SEQ ID NO: | Amino Acid Sequence |
|---|---|---|
| AE48 | 59 | MAEPAGSPTSTEEGTPGSGTASSSPGSSTPSGATGSPGASPGTSSTGS |
| AM48 | 60 | MAEPAGSPTSTEEGASPGTSSTGSPGSSTPSGATGSPGSSTPSGATGS |
| AE144 | 61 | GSEPATSGSETPGTSESATPESGPGSEPATSGSETPGSPAGSPTSTEEGTSTEPSEGSAPGSEP ATSGSETPGSEPATSGSETPGSEPATSGSETPGTSTEPSEGSAPGTSESATPESGPGSEPATSG SETPGTSTEPSEGSAP |
| AF144 | 62 | GTSTPESGSASPGTSPSGESSTAPGTSPSGESSTAPGSTSSTAESPGPGSTSESPSGTAPGSTSS TAESPGPGTSPSGESSTAPGTSTPESGSASPGSTSSTAESPGPGTSPSGESSTAPGTSPSGESST APGTSPSGESSTAP |
| AE288 | 63 | GTSESATPESGPGSEPATSGSETPGTSESATPESGPGSEPATSGSETPGTSESATPESGPGTST EPSEGSAPGSPAGSPTSTEEGTSESATPESGPGSEPATSGSETPGTSESATPESGPGSPAGSPT STEEGSPAGSPTSTEEGTSTEPSEGSAPGTSESATPESGPGTSESATPESGPGTSESATPESGP GSEPATSGSETPGSEPATSGSETPGSPAGSPTSTEEGTSTEPSEGSAPGTSTEPSEGSAPGSEP ATSGSETPGTSESATPESGPGTSTEPSEGSAP |
| AF504 | 64 | GASPGTSSTGSPGSSPSASTGTGPGSSPSASTGTGPGTPGSGTASSSPGSSTPSGATGSPGSXP SASTGTGPGASPGTSSTGSPGTPGSGTASSSPGSSTPSGATGSPGTPGSGTASSSPGASPGTS STGSPGASPGTSSTGSPGTPGSGTASSSPGSSTPSGATGSPGASPGTSSTGSPGTPGSGTASSS PGSSTPSGATGSPGSXPSASTGTGPGSSPSASTGTGPGSSTPSGATGSPGSSTPSGATGSPGA SPGTSSTGSPGASPGTSSTGSPGASPGTSSTGSPGTPGSGTASSSPGASPGTSSTGSPGASPGT SSTGSPGASPGTSSTGSPGSSPSASTGTGPGTPGSGTASSSPGASPGTSSTGSPGASPGTSSTG SPGASPGTSSTGSPGSSTPSGATGSPGSSTPSGATGSPGASPGTSSTGSPGTPGSGTASSSPGS STPSGATGSPGSSTPSGATGSPGSSTPSGATGSPGSSPSASTGTGPGASPGTSSTGSP |
| AF540 | 65 | GSTSSTAESPGPGSTSSTAESPGPGSTSESPSGTAPGSTSSTAESPGPGSTSSTAESPGPGTSTP ESGSASPGSTSESPSGTAPGTSPSGESSTAPGSTSESPSGTAPGSTSESPSGTAPGTSPSGESST APGSTSESPSGTAPGSTSESPSGTAPGTSPSGESSTAPGSTSESPSGTAPGSTSESPSGTAPGS TSESPSGTAPGTSTPESGSASPGSTSESPSGTAPGTSTPESGSASPGSTSSTAESPGPGSTSSTA ESPGPGTSTPESGSASPGTSTPESGSASPGSTSESPSGTAPGTSTPESGSASPGSTSESPSGTAP GSTSESPSGTAPGSTSESPSGTAPGSTSESPSGTAPGSTSSTAESPGPGTSTPESGSASPGTSTP ESGSASPGSTSESPSGTAPGSTSESPSGTAPGTSTPESGSASPGSTSESPSGTAPGSTSESPSGT APGTSTPESGSASPGTSPSGESSTAPGSTSSTAESPGPGTSPSGESSTAPGSTSSTAESPGPGT STPESGSASPGSTSESPSGTAP |
| AD576 | 66 | GSSESGSSEGGPGSGGEPSESGSSGSSESGSSEGGPGSSESGSSEGGPGSSESGSSEGGPGSSE SGSSEGGPGSSESGSSEGGPGESPGGSSGSESGSEGSSGPGESSGSSESGSSEGGPGSSESGSS EGGPGSSESGSSEGGPGSGGEPSESGSSGESPGGSSGSESGSESGSSGGEPSESGS SGSSESGSSEGGPGSGGEPSESGSSGSGGGEPSESGSSGSESGSSGPGESSGESPGGSSGSESGSG GEPSESGSSGSGGEPSESGSSGSGGEPSESGSSGSESGSSEGGPGESPGGSSGSESGESPGGS SGSESGESPGGSSGSESGESPGGSSGSESGESPGGSSGSESGSSESGSSEGGPGSGGEPSESGS SGSEGSSGPGESSGSSESGSSEGGPGSGGEPSESGSSGSSESGSSEGGPGSESGSSGES PGGSSGSESGESPGGSSGSESGSSESGSSEGGPGSGGEPSESGSSGSSESGSSEGGPGSGGEPS ESGSSGSGGEPSESGSSGESPGGSSGSESGSSEGSSGPGESSGSSESGSSEGGPGSEGSSGPGESS |
| AE576 | 67 | GSPAGSPTSTEEGTSESATPESGPGTSTEPSEGSAPGSPAGSPTSTEEGTSTEPSEGSAPGTST EPSEGSAPGTSESATPESGPGSEPATSGSETPGSEPATSGSETPGSPAGSPTSTEEGTSESATP ESGPGTSTEPSEGSAPGTSTEPSEGSAPGSPAGSPTSTEEGTSTEPSEGSAPGTSTEPSEGSAP GTSESATPESGPGTSTEPSEGSAPGTSESATPESGPGSEPATSGSETPGTSTEPSEGSAPGTST EPSEGSAPGTSESATPESGPGTSESATPESGPGSPAGSPTSTEEGTSESATPESGPGSEPATSG SETPGTSESATPESGPGTSTEPSEGSAPGTSTEPSEGSAPGTSTEPSEGSAPGTSTEPSEGSAP GTSTEPSEGSAPGTSTEPSEGSAPGSPAGSPTSTEEGTSTEPSEGSAPGTSESATPESGPGSEP ATSGSETPGTSESATPESGPGSEPATSGSETPGTSESATPESGPGTSTEPSEGSAPGTSESATP ESGPGSPAGSPTSTEEGSPAGSPTSTEEGSPAGSPTSTEEGTSESATPESGPGTSTEPSEGSAP |

TABLE 3-continued

XTEN Polypeptides

| XTEN Name | SEQ ID NO: | Amino Acid Sequence |
|---|---|---|
| AF576 | 68 | GSTSSTAESPGPGSTSSTAESPGPGSTSESPSGTAPGSTSSTAESPGPGSTSSTAESPGPGTSTP<br>ESGSASPGSTSESPSGTAPGTSPSGESSTAPGSTSESPSGTAPGSTSESPSGTAPGTSPSGESST<br>APGSTSESPSGTAPGSTSESPSGTAPGTSPSGESSTAPGSTSESPSGTAPGSTSESPSGTAPGS<br>TSESPSGTAPGTSTPESGSASPGSTSESPSGTAPGTSTPESGSASPGTSSTAESPGPGSTSSTA<br>ESPGPGTSTPESGSASPGTSTPESGSASPGSTSESPSGTAPGTSTPESGSASPGTSTPESGSASP<br>GSTSESPSGTAPGSTSESPSGTAPGSTSESPSGTAPGSTSSTAESPGPGTSTPESGSASPGTSTP<br>ESGSASPGSTSESPSGTAPGSTSESPSGTAPGTSTPESGSASPGTSSESPSGTAPGSTSESPSGT<br>APGTSTPESGSASPGTSPSGESSTAPGSTSSTAESPGPGTSPSGESSTAPGSTSSTAESPGPGT<br>STPESGSASPGSTSESPSGTAPGSTSSTAESPGPGTSTPESGSASPGTSTPESGSASP |
| AE624 | 69 | MAEPAGSPTSTEEGTPGSGTASSSPGSSTPSGATGSPGASPGTSSTGSPGSPAGSPTSTEEGT<br>SESATPESGPGTSTEPSEGSAPGSPAGSPTSTEEGTSTEPSEGSAPGTSTEPSEGSAPGTSESA<br>TPESGPGSEPATSGSETPGSEPATSGSETPGSPAGSPTSTEEGTSESATPESGPGTSTEPSEGS<br>APGTSTEPSEGSAPGSPAGSPTSTEEGTSTEPSEGSAPGTSTEPSEGSAPGTSESATPESGPGT<br>STEPSEGSAPGTSESATPESGPGSEPATSGSETPGTSTEPSEGSAPGTSTEPSEGSAPGTSESA<br>TPESGPGSEPATSGSETPGSPAGSPTSTEEGTSESATPESGPGSEPATSGSETPGTSESATPES<br>GPGTSTEPSEGSAPGTSTEPSEGSAPGTSTEPSEGSAPGTSTEPSEGSAPGTSTEPSEGSAPGT<br>STEPSEGSAPGSPAGSPTSTEEGTSTEPSEGSAPGTSESATPESGPGSEPATSGSETPGTSESA<br>TPESGPGSEPATSGSETPGTSESATPESGPGTSTEPSEGSAPGTSESATPESGPGSPAGSPTST<br>EEGSPAGSPTSTEEGSPAGSPTSTEEGTSESATPESGPGTSTEPSEGSAP |
| AD836 | 70 | GSSESGSSEGGPGSSESGSSEGGPGESPGGSSGSESGSGGEPSESGSSGESPGGSSGSESGESP<br>GGSSGSESGSSESGSSEGGPGSSESGSSEGGPGSSSESGSSEGGPGESPGGSSGSESGESPGGSS<br>GSESGESPGGSSGSESGSSESGSSEGGPGSSESGSSEGGPGSSESGSSEGGPGSSESGSSEGGP<br>GSSESGSSEGGPGSSESGSSEGGPGSGGEPSESGSSGESPGGSSGSESGESPGGSSGSESGSG<br>GEPSESGSSGSEGSSGPGESSGSSESGSSEGGPGSGGEPSESGSSGSEGSSGPGESSGSSESGS<br>SEGGPGSGGEPSESGSSGESPGGSSGSESGSGGEPSESGSSGSEGSSEGGPGSSESGSGSSEG<br>GPGSGGEPSESGSSGSGGEPSESGSSGSSESGSSEGGPGSSESGSSEGGPGESPGGSSGSESGSGGE<br>PSESGSSGSEGSSGPGESSGESPGGSSGSESGSEGSSGPGSSESGSSEGGPGSGGEPSESGSSG<br>SEGSSGPGESSGSEGSSGPGESSGSGGGEPSESGSSGSGGEPSESGSSGESPG<br>GSSGSESGESPGGSSGSESGSGGEPSESGSSGSEGSSGPGESSGESPGGSSGSESGSSESGSSE<br>GGPGSSESGSSEGGPGSSESGSSEGGPGSGGEPSESGSSGSSESGSSEGGPGESPGGSSGSES<br>GSGGEPSESGSSGSSESGSSEGGPGESPGGSSGSESGSGGEPSESGSSGESPGGSSGSESGSG<br>GEPSESGSS |
| AE864 | 71 | GSPAGSPTSTEEGTSESATPESGPGTSTEPSEGSAPGSPAGSPTSTEEGTSTEPSEGSAPGTST<br>EPSEGSAPGTSESATPESGPGSEPATSGSETPGSEPATSGSETPGSPAGSPTSTEEGTSESATP<br>ESGPGTSTEPSEGSAPGTSTEPSEGSAPGSPAGSPTSTEEGTSTEPSEGSAPGTSTEPSEGSAP<br>GTSESATPESGPGTSTEPSEGSAPGTSESATPESGPGSEPATSGSETPGTSTEPSEGSAPGTST<br>EPSEGSAPGTSESATPESGPGTSESATPESGPGSPAGSPTSTEEGTSESATPESGPGSEPATSG<br>SETPGTSESATPESGPGTSTEPSEGSAPGTSTEPSEGSAPGTSTEPSEGSAPGTSTEPSEGSAP<br>GTSTEPSEGSAPGTSTEPSEGSAPGSPAGSPTSTEEGTSTEPSEGSAPGTSESATPESGPGSEP<br>ATSGSETPGTSESATPESGPGSEPATSGSETPGTSESATPESGPGTSTEPSEGSAPGTSESATP<br>ESGPGSPAGSPTSTEEGSPAGSPTSTEEGSPAGSPTSTEEGTSESATPESGPGTSTEPSEGSAP<br>GTSESATPESGPGSEPATSGSETPGTSESATPESGPGSEPATSGSETPGTSESATPESGPGTST<br>EPSEGSAPGSPAGSPTSTEEGTSESATPESGPGSEPATSGSETPGTSESATPESGPGSPAGSPT<br>STEEGSPAGSPTSTEEGTSTEPSEGSAPGTSESATPESGPGTSESATPESGP<br>GSEPATSGSETPGSEPATSGSETPGSPAGSPTSTEEGTSTEPSEGSAPGTSTEPSEGSAPGSEP<br>ATSGSETPGTSESATPESGPGTSTEPSEGSAP |
| AF864 | 72 | GSTSESPSGTAPGTSPSGESSTAPGSTSESPSGTAPGSTSESPSGTAPGTSTPESGSASPGTSTP<br>ESGSASPGSTSESPSGTAPGSTSESPSGTAPGTSPSGESSTAPGSTSESPSGTAPGTSPSGESST<br>APGTSPSGESSTAPGSTSSTAESPGPGTSPSGESSTAPGTSPSGESSTAPGSTSSTAESPGPGT<br>STPESGSASPGTSTPESGSASPGSTSESPSGTAPGSTSESPSGTAPGTSTPESGSASPGTSSTA<br>ESPGPGTSTPESGSASPGSTSESPSGTAPGTSPSGESSTAPGSTSSTAESPGPGTSPSGESSTAP<br>GTSTPESGSASPGSTSSTAESPGPGSTSSTAESPGPGSTSSTAESPGPGSTSSTAESPGPGTSPS<br>GESSTAPGSTSESPSGTAPGTSTPESGPXXXGASASAGAPSTXXXXSESPSG<br>TAPGSTSESPSGTAPGSTSESPSGTAPGSTSESPSGTAPGSTSESPSGTAPGSTSESPSGTAPG<br>TSTPESGSASPGTSPSGESSTAPGTSPSGESSTAPGSTSSTAESPGPGTSPSGESSTAPGTSTPE<br>SGSASPGSTSESPSGTAPGSTSESPSGTAPGTSPSGESSTAPGSTSESPSGTAPGTSTPESGSAS<br>PGTSTPESGSASPGSTSESPSGTAPGTSTPESGSASPGSTSESPSGTAPGSTSESPSGTAPGSTS<br>ESPSGTAPGTSPSGESSTAPGSTSSTAESPGPGTSPSGESSTAPGTSTPESGSASPGTSPSGESS<br>TAPGTSPSGESSTAPGTSPSGESSTAPGSTSSTAESPGPGTSSTAESPGPGTSPSGESSTAPG<br>SSPSASTGTGPGSSTPSGATGSPGSSTPSGATGSP |
| AG864 | 73 | GASPGTSSTGSPGSSPSASTGTGPGSSPSASTGTGPGTPGSGTASSSPGSSTPSGATGSPGSSP<br>SASTGTGPGASPGTSSTGSPGTPGSGTASSSPGSSTPSGATGSPGTPGSGTASSSPGASPGTS<br>STGSPGASPGTSSTGSPGTPGSGTASSSPGSSTPSGATGSPGASPGTSSTGSPGTPGSGTASSS<br>PGSSTPSGATGSPGSSPSASTGTGPGSSPSASTGTGPGASPGTSSTGSPGSTPSGATGSPGASS<br>PGTSSTGSPGASPGTSSTGSPGSSPSASTGTGPGTPGSGTASSSPGASPGTSSTGSPGASPGTS<br>STGSPGASPGTSSTGSPGSSPSASTGTGPGTPGSGTASSSPGASPGTSSTGSPGASPGTSSTGS<br>PGASPGTSSTGSPGSSTPSGATGSPGSSTPSGATGSPGASPGTSSTGSPGTPGSGTASSSPGSS<br>TPSGATGSPGSSTPSGATGSPGSSTPSGATGSPGSSPSASTGTGPGASPGTSSTGSPGASPGT<br>SSTGSPGTPGSGTASSSPGASPGTSSTGSPGASPGTSSTGSPGASPGTSSTGSPGASPGTSSTG |

TABLE 3-continued

XTEN Polypeptides

| XTEN Name | SEQ ID NO: | Amino Acid Sequence |
|---|---|---|
| | | SPGTPGSGTASSSPGSSTPSGATGSPGTPGSGTASSSPGSSTPSGATGSPGTPGSGTASSSPGS<br>STPSGATGSPGSSTPSGATGSPGSSPSASTGTGPGSSPSASTGTGPGASPGTSSTGSPGTPGS<br>GTASSSPGSSTPSGATGSPGSSPSASTGTGPGSSPSASTGTGPGASPGTSSTGSPGASPGTSST<br>GSPGSSTPSGATGSPGSSPSASTGTGPGASPGTSSTGSPGSSPSASTGTGPGTPGSGTASSSPG<br>SSTPSGATGSPGSSTPSGATGSPGASPGTSSTGSP |
| AM875 | 74 | GTSTEPSEGSAPGSEPATSGSETPGSPAGSPTSTEEGSTSSTAESPGPGTSTPESGSASPGSTS<br>ESPSGTAPGSTSESPSGTAPGTSTPESGSASPGTSTPESGSASPGSEPATSGSETPGTSESATP<br>ESGPGSPAGSPTSTEEGTSTEPSEGSAPGTSESATPESGPGTSTEPSEGSAPGTSTEPSEGSAP<br>GSPAGSPTSTEEGTSTEPSEGSAPGTSTEPSEGSAPGTSESATPESGPGTSESATPESGPGTST<br>EPSEGSAPGTSTEPSEGSAPGTSESATPESGPGTSTEPSEGSAPGSEPATSGSETPGSPAGSPT<br>STEEGSTPSGATGSPGTPGSGTASSSPGSSTPSGATGSPGTSTEPSEGSAPGTSTEPSEGSAP<br>GSEPATSGSETPGSPAGSPTSTEEGSPAGSPTSTEEGSTSTAESPGPGSTSESPSGTAPGTSPSGESS<br>TAPGTPGSGTASSSPGSSTPSGATGSPGSSPSASTGTGPGSEPATSGSETPGTSESATPESGPG<br>SEPATSGSETPGSTSSTAESPGPGSTSSTAESPGPGTSPSGESSTAPGSEPATSGSETPGSEPA<br>TSGSETPGTSTEPSEGSAPGSTSSTAESPGPGTSTPESGSASPGSTSESPSGTAPGTSTEPSEGS<br>APGTSTEPSEGSAPGTSTEPSEGSAPGSSTPSGATGSPGSSPSASTGTGPGASPGTSSTGSPGS<br>EPATSGSETPGTSESATPESGPGSPAGSPTSTEEGSSTPSGATGSPGSSPSASTGTGPGASPGT<br>SSTGSPGTSESATPESGPGTSTEPSEGSAPGTSTEPSEGSAP |
| AE912 | 75 | MAEPAGSPTSTEEGTPGSGTASSSPGSSTPSGATGSPGASPGTSSTGSPGSPAGSPTSTEEGT<br>SESATPESGPGTSTEPSEGSAPGSPAGSPTSTEEGTSTEPSEGSAPGTSTEPSEGSAPGTSESA<br>TPESGPGSEPATSGSETPGSEPATSGSETPGSPAGSPTSTEEGTSESATPESGPGTSTEPSEGS<br>APGTSTEPSEGSAPGSPAGSPTSTEEGTSTEPSEGSAPGTSTEPSEGSAPGTSESATPESGPGT<br>STEPSEGSAPGTSESATPESGPGSEPATSGSETPGTSTEPSEGSAPGTSTEPSEGSAPGTSESA<br>TPESGPGTSESATPESGPGSPAGSPTSTEEGTSESATPESGPGSEPATSGSETPGTSESATPES<br>GPGTSTEPSEGSAPGTSTEPSEGSAPGTSTEPSEGSAPGTSTEPSEGSAPGTSTEPSEGSAPGT<br>STEPSEGSAPGSPAGSPTSTEEGTSTEPSEGSAPGTSESATPESGPGSEPATSGSETPGTSESA<br>TPESGPGSEPATSGSETPGTSESATPESGPGTSTEPSEGSAPGTSESATPESGPGSPAGSPTST<br>EEGSPAGSPTSTEEGSPAGSPTSTEEGTSESATPESGPGTSTEPSEGSAPGTSESATPESGPGS<br>EPATSGSETPGTSESATPESGPGSEPATSGSETPGTSESATPESGPGTSTEPSEGSAPGSPAGS<br>PTSTEEGTSESATPESGPGSEPATSGSETPGTSESATPESGPGSPAGSPTSTEEGSPAGSPTST<br>EEGTSTEPSEGSAPGTSESATPESGPGTSESATPESGPGTSESATPESGPGSEPATSGSETPGS<br>EPATSGSETPGSPAGSPTSTEEGTSTEPSEGSAPGTSTEPSEGSAPGSEPATSGSETPGTSESA<br>TPESGPGTSTEPSEGSAP |
| AM923 | 76 | MAEPAGSPTSTEEGASPGTSSTGSPGSSTPSGATGSPGSSTPSGATGSPGTSTEPSEGSAPGS<br>EPATSGSETPGSPAGSPTSTEEGSTSSTAESPGPGTSTPESGSASPGSTSESPSGTAPGSTSESP<br>SGTAPGTSTPESGSASPGTSTPESGSASPGSEPATSGSETPGTSESATPESGPGSPAGSPTSTE<br>EGTSTEPSEGSAPGTSESATPESGPGTSTEPSEGSAPGTSESAPGSPAGSPTSTEEGTS<br>TEPSEGSAPGTSTEPSEGSAPGTSESATPESGPGTSESATPESGPGTSTEPSEGSAPGTSTEPS<br>EGSAPGTSESATPESGPGTSTEPSEGSAPGSEPATSGSETPGSPAGSPTSTEEGSSTPSGATGS<br>PGTPGSGTASSSPGSSTPSGATGSPGTSTEPSEGSAPGTSTEPSEGSAPGSEPATSGSETPGSP<br>AGSPTSTEEGSPAGSPTSTEEGSTPSEGSAPGASASGAPSTGGTSESATPESGPGSPAGSP<br>TSTEEGSPAGSPTSTEEGSTSSTAESPGPGSTSESPSGTAPGTSPSGESSTAPGTPGSGTASSS<br>PGSSTPSGATGSPGSSPSASTGTGPGSEPATSGSETPGTSESATPESGPGSEPATSGSETPGST<br>SSTAESPGPGSTSSTAESPGPGTSPSGESSTAPGSEPATSGSETPGSEPATSGSETPGTSTEPSE<br>GSAPGSTSSTAESPGPGTSTPESGSASPGSTSESPSGTAPGTSTEPSEGSAPGTSTEPSEGSAP<br>GTSTEPSEGSAPGSSTPSGATGSPGSSPSASTGTGPGASPGTSSTGSPGSEPATSGSETPGTSE<br>SATPESGPGSPAGSPTSTEEGSSTPSGATGSPGSSPSASTGTGPGASPGTSSTGSPGTSESATP<br>ESGPGTSTEPSEGSAPGTSTEPSEGSAP |
| AM1318 | 77 | GTSTEPSEGSAPGSEPATSGSETPGSPAGSPTSTEEGSTSSTAESPGPGTSTPESGSASPGSTS<br>ESPSGTAPGSTSESPSGTAPGTSTPESGSASPGTSTPESGSASPGSEPATSGSETPGTSESATP<br>ESGPGSPAGSPTSTEEGTSTEPSEGSAPGTSESATPESGPGTSTEPSEGSAPGTSTEPSEGSAP<br>GSPAGSPTSTEEGTSTEPSEGSAPGTSTEPSEGSAPGTSESATPESGPGTSESATPESGPGTST<br>EPSEGSAPGTSTEPSEGSAPGTSESATPESGPGTSTEPSEGSAPGSEPATSGSETPGSPAGSPT<br>STEEGSTPSGATGSPGTPGSGTASSSPGSSTPSGATGSPGTSTEPSEGSAPGTSTEPSEGSAP<br>GSEPATSGSETPGSPAGSPTSTEEGSPAGSPTSTEEGTSTEPSEGSAPGPEPTGPAPSGGSEPA<br>TSGSETPGTSESATPESGPGSPAGSPTSTEEGTSESATPESGPGSPAGSPTSTEEGSPAGSPTS<br>TEEGTSESATPESGPGSPAGSPTSTEEGSPAGSPTSTEEGSTSSTAESPGPGSTSESPSGTAPG<br>TSPSGESSTAPGSTSESPSGTAPGSTSESPSGTAPGTSPSGESSTAPGTSTEPSEGSAPGTSESA<br>TPESGPGTSESATPESGPGSEPATSGSETPGTSESATPESGPGTSESATPESGPGTSTEPSEGS<br>APGTSESATPESGPGTSTEPSEGSAPGTSPSGESSTAPGTSPSGESSTAPGTSPSGESSTAPGT<br>STEPSEGSAPGSPAGSPTSTEEGTSTEPSEGSAPGSSPSASTGTGPGSSPSASTGTGPGSSPSS<br>GATGSPGSSTPSGATGSPGSSTPSGATGSPGASPGTSSTGSPGASASGAPSTGGTSPSGESST<br>APGSTSSTAESPGPGTSPSGESSTAPGSTSESATPESGPGTSTEPSEGSAPGTSTEPSEGSAPGS<br>SPSASTGTGPGSSTPSGATGSPGASPGTSSTGSPGTSTPESGSASPGTSPSGESSTAPGTSPSG<br>ESSTAPGSTSESATPESGPGSEPATSGSETPGTSESATPESGPGSASPGSSPSGTSESPSGT<br>APGTSTPESGSASPGSPAGSPTSTEEGPGTSTEPSEGSAPGSPAGSPTSTEEGT<br>SESATPESGPGSEPATSGSETPGSSTPSGATGSPGASPGTSSTGSPGSSTPSGATGSPGSTSES<br>PSGTAPGTSPSGESSTAPGSTSSTAESPGPGSSTPSGATGSPGASPGTSSTGSPGTPGSGTASS<br>SPGSPAGSPTSTEEGSPAGSPTSTEEGTSTEPSEGSAP |

TABLE 3-continued

XTEN Polypeptides

| XTEN Name | SEQ ID NO: | Amino Acid Sequence |
|---|---|---|
| BC 864 | 78 | GTSTEPSEPGSAGTSTEPSEPGSAGSEPATSGTEPSGSGASEPTSTEPGSEPATSGTEPSGSEP<br>ATSGTEPSGSEPATSGTEPSGSGASEPTSTEPGTSTEPSEPGSAGSEPATSGTEPSGTSTEPSE<br>PGSAGSEPATSGTEPSGSEPATSGTEPSGTSTEPSEPGSAGTSTEPSEPGSAGSEPATSGTEPS<br>GSEPATSGTEPSGTSEPSTSEPGAGSGASEPTSTEPGTSEPSTSEPGAGSEPATSGTEPSGSEP<br>ATSGTEPSGTSTEPSEPGSAGTSTEPSEPGSAGSGASEPTSTEPGSEPATSGTEPSGSEPATSG<br>TEPSGSEPATSGTEPSGSEPATSGTEPSGTSTEPSEPGSAGSEPATSGTEPSGSGASEPTSTEP<br>GTSTEPSEPGSAGSEPATSGTEPSGSGASEPTSTEPGTSTEPSEPGSAGSGASEPTSTEPGSEP<br>ATSGTEPSGSGASEPTSTEPGSEPATSGTEPSGSGASEPTSTEPGTSTEPSEPGSAGSEPATSG<br>TEPSGSGASEPTSTEPGTSTEPSEPGSAGSEPATSGTEPSGTSTEPSEPGSAGSEPATSGTEPS<br>GTSTEPSEPGSAGTSTEPSEPGSAGTSTEPSEPGSAGTSTEPSEPGSAGTSTEPSEPGSAGTST<br>EPSEPGSAGTSEPSTSEPGAGSGASEPTSTEPGTSTEPSEPGSAGTSTEPSEPGSAGTSTEPSE<br>PGSAGSEPATSGTEPSGSGASEPTSTEPGSEPATSGTEPSGSEPATSGTEPSGSEPATSGTEPS<br>GSEPATSGTEPSGTSEPSTSEPGAGSEPATSGTEPSGSGASEPTSTEPGTSTEPSEPGSAGSEP<br>ATSGTEPSGSGASEPTSTEPGTSTEPSEPGSA |
| BD864 | 79 | GSETATSGSETAGTSESATSESGAGSTAGSETSTEAGTSESATSESGAGSETATSGSETAGS<br>ETATSGSETAGTSTEASEGSASGTSTEASEGSASGTSESATSESGAGSETATSGSETAGTSTE<br>ASEGSASGSTAGSETSTEAGTSESATSESGAGTSESATSESGAGSETATSGSETAGTSESATS<br>ESGAGTSTEASEGSASGSETATSGSETAGSETATSGSETAGTSTEASEGSASGSTAGSETSTT<br>EAGTSESATSESGAGTSTEASESGSASGSETATSGSETAGSTAGSETSTEAGSTAGSETSTEA<br>GSETATSGSETAGTSESATSESGAGTSESATSESGAGSETATSGSETAGTSESATSESGAGTS<br>ESATSESGAGSETATSGSETAGSETATSGSETAGTSTEASEGSASGSTAGSETSTEAGSETA<br>TSGSETAGTSESATSESGAGSTAGSETSTEAGSTAGSETSTEAGSTAGSETSTEAGTSTEASE<br>GSASGSTAGSETSTEAGSTAGSETSTEAGTSTEASEGSASGSTAGSETSTEAGSETATSGSE<br>TAGTSTEASEGSASGTSESATSESGAGSETATSGSETAGTSESATSESGAGTSESATSESGA<br>GSETATSGSETAGTSESATSESGAGSETATSGSETAGTSTEASEGSASGTSTEASEGSASGST<br>AGSETSTEAGSTAGSETSTEAGSETATSGSETAGTSESATSESGAGTSESATSESGAGSETA<br>TSGSETAGSETATSGSETAGSETATSGSETAGTSTEASEGSASGTSESATSESGAGSETATS<br>GSETAGSETATSGSETAGTSESATSESGAGTSESATSESGAGSETATSGSETA |

4. XTEN Segments

In one embodiment, the invention provides an isolated GHXTEN fusion protein wherein the cumulative length of the XTEN component is greater than about 100 to about 3000 amino acid residues containing at least one polypeptide sequence segment selected from Tables 3, 8, 9, 10, 11, and 12 and wherein at least about 90%, or at least about 91%, or at least about 92%, or at least about 93%, or at least about 94%, or at least about 95%, or at least about 96%, or at least about 97%, or at least about 98% or more of the remainder of the XTEN sequence by and large contains hydrophilic amino acids and less than about 2% of the remainder of the XTEN consists of hydrophobic or aromatic amino acids, or cysteine. In some embodiments, the XTEN contains multiple segments wherein the segments are identical or different. In another embodiment, the invention provides an isolated GHXTEN fusion protein wherein the cumulative length of the XTEN component is greater than about 100 to about 3000 amino acid residues and comprises at least one sequence segment of at least about 100 to about 923, or at least about 100 to about 875, or at least about 100 to about 576, or at least about 100 to about 288, or at least about 100 to about 144 amino acid residues wherein the sequence segment(s) consists of at least three different types of amino acids and the sum of glycine (G), alanine (A), serine (S), threonine (T), glutamate (E) and proline (P) residues in the sequence segment(s) constitutes at least about 90%, or at least about 91%, or at least about 92%, or at least about 93%, or at least about 94%, or at least about 95%, or at least about 96%, or at least about 97%, or at least about 98%, or at least about 99% of the total amino acid sequence of the sequence segment and at least about 90%, or at least about 91%, or at least about 92%, or at least about 93%, or at least about 94%, or at least about 95%, or at least about 96%, or at least about 97%, or at least about 98% of the remainder of the XTEN sequence(s) consist of hydrophilic amino acids and less than about 2% of the remainder of the XTEN sequence(s) consists of hydrophobic oraromatic amino acids, or cysteine. In another embodiment, the invention provides an isolated GHXTEN fusion protein wherein the cumulative length of the XTEN component is greater than about 100 to about 3000 amino acid residues and comprises at least one sequence segment of at least about 200 to about 923, or at least about 200 to about 875, or at least about 200 to about 576, or at least about 200 to about 288 amino acid residues wherein the sequence segment(s) the sum of glycine (G), alanine (A), serine (S), threonine (T), glutamate (E) and proline (P) residues in the sequence segment(s) constitutes at least about 90%, or at least about 91%, or at least about 92%, or at least about 93%, or at least about 94%, or at least about 95%, or at least about 96%, or at least about 97%, or at least about 98%, or at least about 99% of the total amino acid sequence of the sequence segment and wherein the subsequence score of the segment is less than 12, more preferably less than 10, more preferably less than 9, more preferably less than 8, more preferably less than 7, more preferably less than 6, and most preferably less than 5, and at least about 90%, or at least about 91%, or at least about 92%, or at least about 93%, or at least about 94%, or at least about 95%, or at least about 96%, or at least about 97%, or at least about 98% of the remainder of the XTEN sequence(s) consist of hydrophilic amino acids and less than about 2% of the remainder of the XTEN sequence(s) consists of hydrophobic, aromatic or cysteine amino acids.

5. N-Terminal XTEN Expression-Enhancing Sequences

In some embodiments, the invention provides a short-length XTEN sequence incorporated as the N-terminal portion of the GHXTEN fusion protein. The expression of the fusion protein is enhanced in a host cell transformed with a suitable expression vector comprising an optimized N-terminal leader polynucleotide sequence (that encodes the N-terminal XTEN) incorporated into the polynucleotide encoding the binding fusion protein. It has been discovered, as described in Examples 14-17, that a host cell transformed with such an expression vector comprising an optimized N-terminal leader sequence (NTS) in the binding fusion protein gene results in greatly-enhanced expression of the fusion protein compared to the expression of a corresponding fusion protein from a polynucleotide not comprising the NTS, and obviates the need for incorporation of a non-XTEN leader sequence used to enhance expression. In one embodiment, the invention provides GHXTEN fusion proteins comprising an NTS wherein the expression of the binding fusion protein from the encoding gene in a host cell is enhanced about 50%, or about 75%, or about 100%, or about 150%, or about 200%, or about 400% compared to expression of a GHXTEN fusion protein not comprising the N-terminal XTEN sequence (where the encoding gene lacks the NTS).

In one embodiment, the N-terminal XTEN polypeptide of the GHXTEN comprises a sequence that exhibits at least about 80%, more preferably at least about 90%, more preferably at least about 91%, more preferably at least about 92%, more preferably at least about 93%, more preferably at least about 94%, more preferably at least about 95%, more preferably at least about 96%, more preferably at least about 97%, more preferably at least about 98%, more preferably at least 99%, or exhibits 100% sequence identity to the amino acid sequence of AE48 or AM48, the respective amino acid sequences of which are as follows:

```
AE48:
                                        (SEQ ID NO: 80)
MAEPAGSPTSTEEGTPGSGTASSSPGSSTPSGATGSPGASPGTSSTGS

AM48:
                                        (SEQ ID NO: 81)
MAEPAGSPTSTEEGASPGTSSTGSPGSSTPSGATGSPGSSTPSGATGS
```

In another embodiment, the short-length N-terminal XTEN is linked to an XTEN of longer length to form the N-terminal region of the GHXTEN fusion protein, wherein the polynucleotide sequence encoding the short-length N-terminal XTEN confers the property of enhanced expression in the host cell, and wherein the long length of the expressed XTEN contributes to the enhanced properties of the XTEN carrier in the fusion protein, as described above. In the foregoing, the short-length XTEN is linked to any of the XTEN disclosed herein (e.g., an XTEN of Table 3) and the resulting XTEN, in turn, is linked to the N-terminal of any of the GH disclosed herein (e.g., a GH of Table 1) as a component of the fusion protein. Alternatively, polynucleotides encoding the short-length XTEN (or its complement) is linked to polynucleotides encoding any of the XTEN (or its complement) disclosed herein and the resulting gene encoding the N-terminal XTEN, in turn, is linked to the 5' end of polynucleotides encoding any of the GH (or to the 3' end of its complement) disclosed herein. In some embodiments, the N-terminal XTEN polypeptide with long length exhibits at least about 80%, or at least about 90%, or at least about 91%, or at least about 92%, or at least about 93%, or at least about 94%, or at least about 95%, or at least about 96%, or at least about 97%, or at least about 98%, or at least 99%, or exhibits 100% sequence identity to an amino acid sequence selected from the group consisting of the sequences AE624, AE912, and AM923.

In any of the foregoing N-terminal XTEN embodiments described above, the N-terminal XTEN can have from about one to about six additional amino acid residues, preferably selected from GESTPA, to accommodate the restriction endonuclease restriction sites that would be employed to join the nucleotides encoding the N-terminal XTEN to the gene encoding the targeting moiety of the fusion protein. The methods for the generation of the N-terminal sequences and incorporation into the fusion proteins of the invention are described more fully in the Examples.

6. Net Charge

In other embodiments, the XTEN polypeptides have an unstructured characteristic imparted by incorporation of amino acid residues with a net charge and/or reducing the proportion of hydrophobic amino acids in the XTEN sequence. The overall net charge and net charge density is controlled by modifying the content of charged amino acids in the XTEN sequences. In some embodiments, the net charge density of the XTEN of the compositions may be above +0.1 or below −0.1 charges/residue. In other embodiments, the net charge of a XTEN can be about 0%, about 1%, about 2%, about 3%, about 4%, about 5%, about 6%, about 7%, about 8%, about 9%, about 10% about 11%, about 12%, about 13%, about 14%, about 15%, about 16%, about 17%, about 18%, about 19%, or about 20% or more.

Since most tissues and surfaces in a human or animal have a net negative charge, in some embodiments, the XTEN sequences are designed to have a net negative charge to minimize non-specific interactions between the XTEN containing compositions and various surfaces such as blood vessels, healthy tissues, or various receptors. Not to be bound by a particular theory, the XTEN can adopt open conformations due to electrostatic repulsion between individual amino acids of the XTEN polypeptide that individually carry a net negative charge and that are distributed across the sequence of the XTEN polypeptide. Such a distribution of net negative charge in the extended sequence lengths of XTEN can lead to an unstructured conformation that, in turn, can result in an effective increase in hydrodynamic radius. In preferred embodiments, the negative charge is conferred by incorporation of glutamic acid residues. Accordingly, in one embodiment the invention provides XTEN in which the XTEN sequences contain about 8, 10, 15, 20, 25, or even about 30% glutamic acid. Generally, the glutamic residues would be spaced uniformly across the XTEN sequence. In some cases, the XTEN can contain about 10-80, or about 15-60, or about 20-50 glutamic residues per 20 kD of XTEN that can result in an XTEN with charged residues that would have very similar pKa, which can increase the charge homogeneity of the product and sharpen its isoelectric point, enhancing the physicochemical properties of the resulting GHXTEN fusion protein for, example, simplifying purification procedures.

The XTEN of the compositions of the present invention generally have no or a low content of positively charged amino acids. In some embodiments the XTEN may have less than about 10% amino acid residues with a positive charge, or less than about 7%, or less than about 5%, or less than about 2%, or less than about 1% amino acid residues with a positive charge. However, the invention contemplates constructs where a limited number of amino acids with a positive charge, such as lysine, are incorporated into XTEN to permit conjugation between the epsilon amine of the lysine and a reactive group on a peptide, a linker bridge, or a reactive group on a drug or small molecule to be conjugated to the XTEN backbone. In one embodiment of the foregoing, the XTEN has between about 1 to about 100 lysine residues, or about 1 to about 70 lysine residues, or about 1 to about 50 lysine residues, or about 1 to about 30 lysine residues, or about 1 to about 20 lysine residues, or about 1 to about 10 lysine residues, or about 1 to about 5 lysine residues, or alternatively only a single lysine residue. Using the foregoing lysine-containing XTEN, fusion proteins are constructed that comprises XTEN, a growth hormone, plus a chemotherapeutic agent useful in the treatment of growth-related diseases or disorders, wherein the maximum number of molecules of the agent incorporated into the XTEN component is determined by the numbers of lysines or other amino acids with reactive side chains (e.g., cysteine) incorporated into the XTEN.

In some embodiments, the XTEN sequence comprises charged residues separated by other residues such as serine or glycine, which leads to better expression or purification behavior. Based on the net charge, some XTENs have an isoelectric point (pI) of 1.0, 1.5, 2.0, 2.5, 3.0, 3.5, 4.0, 4.5, 5.0, 5.5, 6.0, or even 6.5. In preferred embodiments, the XTEN will have an isoelectric point between 1.5 and 4.5. In these embodiments, the XTEN incorporated into the GHXTEN fusion protein compositions of the present invention carry a net negative charge under physiologic conditions that contribute to the unstructured conformation and reduced binding of the XTEN component to mammalian proteins and tissues.

As hydrophobic amino acids impart structure to a polypeptide, the invention provides that the content of hydrophobic amino acids in the XTEN will typically be less than 5%, or less than 2%, or less than 1% hydrophobic amino acid content. In one embodiment, the amino acid content of methionine and tryptophan in the XTEN component of a GHXTEN fusion protein is typically less than 5%, or less than 2%, and most preferably less than 1%. In another embodiment, the XTEN will have a sequence that has less than 10% amino acid residues with a positive charge, or less than about 7%, or less that about 5%, or less than about 2% amino acid residues with a positive charge, the sum of methionine and tryptophan residues will be less than 2%, and the sum of asparagine and glutamine residues will be less than 10% of the total XTEN sequence.

7. Low Immunogenicity

In another aspect, the invention provides compositions in which the XTEN sequences have a low degree of immunogenicity or are substantially non-immunogenic. Several factors can contribute to the low immunogenicity of XTEN, e.g., the non-repetitive sequence, the unstructured conformation, the high degree of solubility, the low degree or lack of self-aggregation, the low degree or lack of proteolytic sites within the sequence, and the low degree or lack of epitopes in the XTEN sequence.

Conformational epitopes are formed by regions of the protein surface that are composed of multiple discontinuous amino acid sequences of the protein antigen. The precise folding of the protein brings these sequences into a well-defined, stable spatial configurations, or epitopes, that can be recognized as "foreign" by the host humoral immune system, resulting in the production of antibodies to the protein or the activation of a cell-mediated immune response. In the latter case, the immune response to a protein in an individual is heavily influenced by T-cell epitope recognition that is a function of the peptide binding specificity of that individual's HLA-DR allotype. Engagement of a MHC Class II peptide complex by a cognate T-cell receptor on the surface of the T-cell, together with the cross-binding of certain other co-receptors such as the CD4 molecule, can induce an activated state within the T-cell. Activation leads to the release of cytokines further activating other lymphocytes such as B cells to produce antibodies or activating T killer cells as a full cellular immune response.

The ability of a peptide to bind a given MHC Class II molecule for presentation on the surface of an APC (antigen presenting cell) is dependent on a number of factors; most notably its primary sequence. In one embodiment, a lower degree of immunogenicity is achieved by designing XTEN sequences that resist antigen processing in antigen presenting cells, and/or choosing sequences that do not bind MHC receptors well. The invention provides GHXTEN fusion proteins with substantially non-repetitive XTEN polypeptides designed to reduce binding with MHC II receptors, as well as avoiding formation of epitopes for T-cell receptor or antibody binding, resulting in a low degree of immunogenicity. Avoidance of immunogenicity is, in part, a direct result of the conformational flexibility of XTEN sequences; i.e., the lack of secondary structure due to the selection and order of amino acid residues. For example, of particular interest are sequences having a low tendency to adapt compactly folded conformations in aqueous solution or under physiologic conditions that could result in conformational epitopes. The administration of fusion proteins comprising XTEN, using conventional therapeutic practices and dosing, would generally not result in the formation of neutralizing antibodies to the XTEN sequence, and also reduce the immunogenicity of the GH fusion partner in the GHXTEN compositions.

In one embodiment, the XTEN sequences utilized in the subject fusion proteins can be substantially free of epitopes recognized by human T cells. The elimination of such epitopes for the purpose of generating less immunogenic proteins has been disclosed previously; see for example WO 98/52976, WO 02/079232, and WO 00/3317 which are incorporated by reference herein. Assays for human T cell epitopes have been described (Stickler, M., et al. (2003) *J Immunol Methods,* 281: 95-108). Of particular interest are peptide sequences that can be oligomerized without generating T cell epitopes or non-human sequences. This is achieved by testing direct repeats of these sequences for the presence of T-cell epitopes and for the occurrence of 6 to 15-mer and, in particular, 9-mer sequences that are not human, and then altering the design of the XTEN sequence to eliminate or disrupt the epitope sequence. In some embodiments, the XTEN sequences are substantially non-immunogenic by the restriction of the numbers of epitopes of the XTEN predicted to bind MHC receptors. With a reduction in the numbers of epitopes capable of binding to MHC receptors, there is a concomitant reduction in the potential for T cell activation as well as T cell helper function, reduced B cell activation or upregulation and reduced antibody production. The low degree of predicted T-cell epitopes can be determined by epitope prediction algorithms such as, e.g., TEPITOPE (Sturniolo, T., et al. (1999) Nat Biotechnol, 17: 555-61), as shown in Example 45. The TEPITOPE score of a given peptide frame within a protein is the log of the $K_d$ (dissociation constant, affinity, off-rate) of the binding of that peptide frame to multiple of the most common human MHC alleles, as disclosed in Sturniolo, T. et al. (1999) *Nature Biotechnology* 17:555). The score ranges over at least 20 logs, from about 10 to about −10 (corresponding to binding constraints of $10e^{10}$ $K_d$ to $10e^{-10}$ $K_d$), and can be reduced by avoiding hydrophobic amino acids that serve as anchor residues during peptide display on MHC, such as M, I, L, V, F. In some embodiments, an XTEN component incorporated into a GHXTEN does not have a predicted T-cell epitope at a TEPITOPE score of about −5 or greater, or −6 or greater, or −7 or greater, or −8 or greater, or at a TEPITOPE score of −9 or greater. As used herein, a score of "−9 or greater" would encompass TEPITOPE scores of 10 to −9, inclusive, but would not encompass a score of −10, as −10 is less than −9.

In another embodiment, the inventive XTEN sequences, including those incorporated into the subject GHXTEN fusion proteins, are rendered substantially non-immunogenic by the restriction of known proteolytic sites from the sequence of the XTEN, reducing the processing of XTEN into small peptides that can bind to MHC II receptors. In another embodiment, the XTEN sequence is rendered substantially non-immunogenic by the use a sequence that is substantially devoid of secondary structure, conferring resistance to many proteases due to the high entropy of the structure. Accordingly, the reduced TEPITOPE score and elimination of known proteolytic sites from the XTEN render the XTEN compositions, including the XTEN of the GHXTEN fusion protein compositions, substantially unable to be bound by mammalian receptors, including those of the immune system. In one embodiment, an XTEN of a GHXTEN fusion protein can have >100 nM $K_d$ binding to a mammalian receptor, or greater than 500 nM $K_d$, or greater than 1 μM $K_d$ towards a mammalian cell surface or circulating polypeptide receptor.

Additionally, the non-repetitive sequence and corresponding lack of epitopes of XTEN limit the ability of B cells to bind to or be activated by XTEN. A repetitive sequence is recognized and can form multivalent contacts with even a few B cells and, as a consequence of the cross-linking of multiple T-cell independent receptors, can stimulate B cell proliferation and antibody production. In contrast, while a XTEN can make contacts with many different B cells over its extended sequence, each individual B cell may only make one or a small number of contacts with an individual XTEN due to the lack of repetitiveness of the sequence. Not being to be bound by any theory, XTENs typically have a much lower tendency to stimulate proliferation of B cells and thus an immune response. In one embodiment, the GHXTEN have reduced immunogenicity as compared to the corresponding GH that is not fused. In one embodiment, the administration of up to three parenteral doses of a GHXTEN to a mammal result in detectable anti-GHXTEN IgG at a serum dilution of 1:100 but not at a dilution of 1:1000. In another embodiment, the administration of up to three parenteral doses of a GHXTEN to a mammal result in detectable anti-GH IgG at a serum dilution of 1:100 but not at a dilution of 1:1000. In another embodiment, the administration of up to three parenteral doses of a GHXTEN to a mammal result in detectable anti-XTEN IgG at a serum dilution of 1:100 but not at a dilution of 1:1000. In the foregoing embodiments, the mammal can be a mouse, a rat, a rabbit, or a cynomolgus monkey.

An additional feature of XTENs with non-repetitive sequences relative to sequences with a high degree of repetitiveness is non-repetitive XTENs form weaker contacts with antibodies. Antibodies are multivalent molecules. For instance, IgGs have two identical binding sites and IgMs contain 10 identical binding sites. Thus antibodies against repetitive sequences can form multivalent contacts with such repetitive sequences with high avidity, which can affect the potency and/or elimination of such repetitive sequences. In contrast, antibodies against non-repetitive XTENs may yield monovalent interactions, resulting in less likelihood of immune clearance such that the GHXTEN compositions can remain in circulation for an increased period of time.

8. Increased Hydrodynamic Radius

In another aspect, the present invention provides XTEN in which the XTEN polypeptides have a high hydrodynamic radius that confers a corresponding increased Apparent Molecular Weight to the GHXTEN fusion protein incorporating the XTEN. As detailed in Example 37, the linking of XTEN to GH sequences results in GHXTEN compositions that can have increased hydrodynamic radii, increased Apparent Molecular Weight, and increased Apparent Molecular Weight Factor compared to a GH not linked to an XTEN. For example, in therapeutic applications in which prolonged half-life is desired, compositions in which a XTEN with a high hydrodynamic radius is incorporated into a fusion protein comprising one or more GH can effectively enlarge the hydrodynamic radius of the composition beyond the glomerular pore size of approximately 3-5 nm (corresponding to an apparent molecular weight of about 70 kDA) (Caliceti. 2003. Pharmacokinetic and biodistribution properties of poly(ethylene glycol)-protein conjugates. Adv Drug Deliv Rev 55:1261-1277), resulting in reduced renal clearance of circulating proteins. The hydrodynamic radius of a protein is determined by its molecular weight as well as by its structure, including shape or compactness. Not to be bound by a particular theory, the XTEN can adopt open conformations due to electrostatic repulsion between individual charges of the peptide or the inherent flexibility imparted by the particular amino acids in the sequence that lack potential to confer secondary structure. The open, extended and unstructured conformation of the XTEN polypeptide can have a greater proportional hydrodynamic radius compared to polypeptides of a comparable sequence length and/or molecular weight that have secondary and/or tertiary structure, such as typical globular proteins. Methods for determining the hydrodynamic radius are well known in the art, such as by the use of size exclusion chromatography (SEC), as described in U.S. Pat. Nos. 6,406,632 and 7,294,513. As the results of Example 37 demonstrate, the addition of increasing lengths of XTEN results in proportional increases in the parameters of hydrodynamic radius, Apparent Molecular Weight, and Apparent Molecular Weight Factor, permitting the tailoring of GHXTEN to desired characteristic cut-off Apparent Molecular Weights or hydrodynamic radii. Accordingly, in certain embodiments, the GHXTEN fusion protein can be configured with an XTEN such that the fusion protein can have a hydrodynamic radius of at least about 5 nm, or at least about 8 nm, or at least about 10 nm, or 12 nm, or at least about 15 nm. In the foregoing embodiments, the large hydrodynamic radius conferred by the XTEN in an GHXTEN fusion protein can lead to reduced renal clearance of the resulting fusion protein, leading to a corresponding increase in terminal half-life, an increase in mean residence time, and/or a decrease in renal clearance rate.

In another embodiment, an XTEN of a chosen length and sequence can be selectively incorporated into a GHXTEN to create a fusion protein that have, under physiologic conditions, an Apparent Molecular Weight of at least about 150 kDa, or at least about 300 kDa, or at least about 400 kDa, or at least about 500 kDA, or at least about 600 kDa, or at least about 700 kDA, or at least about 800 kDa, or at least about 900 kDa, or at least about 1000 kDa, or at least about 1200 kDa, or at least about 1500 kDa, or at least about 1800 kDa, or at least about 2000 kDa, or at least about 2300 kDa or more. In another embodiment, an XTEN of a chosen length and sequence can be selectively linked to a GH to result in a GHXTEN fusion protein that has, under physiologic conditions, an Apparent Molecular Weight Factor of at least three, alternatively of at least four, alternatively of at least five, alternatively of at least six, alternatively of at least eight, alternatively of at least 10, alternatively of at least 15, or an Apparent Molecular Weight Factor of at least 20 or greater. In another embodiment, the GHXTEN fusion protein has, under physiologic conditions, an Apparent Molecular Weight Factor that is about 4 to about 20, or is about 6 to about 15, or is about 8 to about 12, or is about 9 to about 10 relative to the actual molecular weight of the fusion protein.

V). GHXTEN Structural Configurations and Properties

The GH of the subject compositions are not limited to native, full-length polypeptides, but also include recombinant versions as well as biologically and/or pharmacologically active variants or fragments thereof. For example, it will be appreciated that various amino acid deletions, insertions and substitutions can be made in the GH to create variants without departing from the spirit of the invention with respect to the biological activity or pharmacologic properties of the GH. Examples of conservative substitutions for amino acids in polypeptide sequences are shown in Table 4. However, in embodiments of the GHXTEN in which the sequence identity of the GH is less than 100% compared to a specific sequence disclosed herein, the invention contemplates substitution of any of the other 19 natural L-amino acids for a given amino acid residue of the given GH, which may be at any position within the sequence of the GH, including adjacent amino acid residues. If any one substitution results in an undesirable change in biological activity, then one of the alternative amino acids can be employed and the construct evaluated by the methods described herein, or using any of the techniques and guidelines for conservative and non-conservative mutations set forth, for instance, in U.S. Pat. No. 5,364,934, the contents of which is incorporated by reference in its entirety, or using methods generally known in the art. In addition, variants can include, for instance, polypeptides wherein one or more amino acid residues are added or deleted at the N- or C-terminus of the full-length native amino acid sequence of a GH that retains some if not all of the biological activity of the native peptide.

TABLE 4

Exemplary conservative amino acid substitutions

| Original Residue | Exemplary Substitutions |
|---|---|
| Ala (A) | val; leu; ile |
| Arg (R) | lys; gin; asn |
| Asn (N) | gin; his; Iys; arg |
| Asp (D) | glu |
| Cys (C) | ser |
| Gln (Q) | asn |
| Glu (E) | asp |
| Gly (G) | pro |
| His (H) | asn: gin: Iys: arg |
| xIle (I) | leu; val; met; ala; phe: norleucine |
| Leu (L) | norleucine: ile: val; met; ala: phe |
| Lys (K) | arg: gin: asn |
| Met (M) | leu; phe; ile |
| Phe (F) | leu: val: ile; ala |
| Pro (P) | gly |
| Ser (S) | thr |
| Thr (T) | ser |
| Trp (W) | tyr |
| Tyr(Y) | trp: phe: thr: ser |
| Val (V) | ile: leu; met; phe; ala; norleucine |

(a) GHXTEN Fusion Protein Configurations

The invention provides GHXTEN fusion protein compositions with the GH and XTEN components linked in specific N- to C-terminus configurations. In some embodiments, one or more GHs are linked to one or more XTENs, either at the N-terminus or at the C-terminus, with or without a spacer, to form a block copolymer, and the sequential arrangement of the GHs and the XTENs in the GHXTEN fusion protein are the same as the configuration known in the block copolymer chemistry. When there is more than one GH, XTEN, or spacer, each of the GH, the XTEN, or the spacer have the same or different sequences, and the GHs and/or XTENs are linked either continuously or alternately (regular or irregular). Thus, in all of the formulae provided herein, when there is more than one GH, XTEN, or spacer, each of the GH, XTEN, and spacer are the same or different. In some embodiments, the GHXTEN is a monomeric fusion protein with a GH linked to one XTEN polypeptide. In other embodiments, the GHXTEN is a monomeric fusion protein with a GH linked to two or more XTEN polypeptides. In still other embodiments, the GHXTEN is a monomeric fusion protein with two or more GH linked to one XTEN polypeptide. In still other embodiments, the GHXTEN is a monomeric fusion protein with two or more GH linked to two or more XTEN polypeptide. Table 5 provides non-limiting examples of configurations that are encompassed by the GHXTEN fusion proteins of the invention; numerous other variations will be apparent to the ordinarily skilled artisan, including the incorporation the spacer and cleavage sequences disclosed herein or known in the art.

TABLE 5

GHXTEN configurations

| Components* | Configuration** |
|---|---|
| Single GH; Single XTEN | GH-XTEN |
|  | XTEN-GH |
| Single GH; Multiple XTEN | XTEN-GH-XTEN |
|  | GH-XTEN-XTEN |
|  | XTEN-XTEN-GH |
|  | XTEN-GH-XTEN-XTEN |
|  | XTEN-XTEN-GH-XTEN |
|  | XTEN-XTEN-GH-XTEN |
| Multiple GH, Single XTEN | GH-XTEN-GH |
|  | XTEN-GH-GH |
|  | GH-GH-XTEN |
|  | GH-XTEN-GH-GH |
| Multiple GH; Multiple XTEN | GH-XTEN-GH-XTEN |
|  | XTEN-GH-XTEN-GH |
|  | XTEN-XTEN-GH-XTEN-GH |
|  | XTEN-XTEN-GH-XTEN |
|  | GH-XTEN-XTEN-GH |
|  | GH-GH-XTEN-XTEN |
|  | GH-GH-XTEN-XTEN-GH |
|  | GH-XTEN-GH-XTEN-GH |

*Characterized as single for 1 component or multiple for 2 or more of that component
**Reflects N- to C-terminus configuration of the growth factor and XTEN components The invention contemplates GHXTEN fusion proteins compositions comprising, but not limited to single or multiple GH selected from Table 1 (or fragments or sequence variants thereof), single or multiple XTEN selected from Table 3 (or sequence variants thereof) that are in a configuration shown in Table 5. Generally, the resulting GHXTEN retains at least a portion of the biological activity of the corresponding GH not linked to the XTEN. In other embodiments, the GH component either becomes biologically active or has an increase in activity upon its release from the XTEN by cleavage of an optional cleavage sequence incorporated within spacer sequences into the GHXTEN, described more fully below.

In one embodiment of the GHXTEN composition, the invention provides a fusion protein of formula I:

(XTEN)$_x$-GH-(XTEN)$_y$     I wherein independently for each occurrence, GH is a is a growth hormone; x is either 0 or 1 and y is either 0 or 1 wherein x+y≥1; and XTEN is an extended recombinant polypeptide.

In another embodiment of the GHXTEN composition, the invention provides a fusion protein of formula II:

(XTEN)$_x$-(GH)-(S)$_y$-(XTEN)$_y$     II wherein independently for each occurrence, GH is a is a growth hormone a; S is a spacer sequence having between 1 to about 50 amino acid residues that can optionally include a cleavage sequence; x is either 0 or 1 and y is either 0 or 1 wherein x+y≥1; and XTEN is an extended recombinant polypeptide.

In another embodiment, the invention provides an isolated fusion protein, wherein the fusion protein is of formula III:

(GH)-(S)$_x$-(XTEN)-(S)$_y$-(GH)-(S)$_z$-(XTEN)$_z$     III wherein independently for each occurrence, GH is a is a growth hormone; S is a spacer sequence having between 1 to about 50 amino acid residues that can optionally include a cleavage sequence; x is either 0 or 1; y is either 0 or 1; z is either 0 or 1; and XTEN is an extended recombinant polypeptide.

In another embodiment, the invention provides an isolated fusion protein, wherein the fusion protein is of formula IV:

(XTEN)$_x$-(S)$_y$-(GH)-(S)$_z$-(XTEN)-(GH)     IV wherein independently for each occurrence, GH is a is a growth hormone; S is a spacer sequence having between 1 to about 50 amino acid residues that can optionally include a cleavage sequence; x is either 0 or 1; y is either 0 or 1; z is either 0 or 1; and XTEN is an extended recombinant polypeptide.

In another embodiment, the invention provides an isolated fusion growth hormone, wherein the fusion protein is of formula V:

(GH)$_x$-(S)$_x$-(GH)-(S)$_y$-(XTEN)     V wherein independently for each occurrence, GH is a is a growth hormone; S is a spacer sequence having between 1 to about 50 amino acid residues that can optionally include a cleavage sequence; x is either 0 or 1; y is either 0 or 1; and XTEN is an extended recombinant polypeptide.

In another embodiment, the invention provides an isolated fusion protein, wherein the fusion protein is of formula VI:

(XTEN)-(S)$_x$-(GH)-(S)$_y$-(GH)     VI wherein independently for each occurrence, GH is a is a growth hormone; S is a spacer sequence having between 1 to about 50 amino acid residues that can optionally include a cleavage sequence; x is either 0 or 1; y is either 0 or 1; and XTEN is an extended recombinant polypeptide.

In another embodiment, the invention provides an isolated fusion protein, wherein the fusion protein is of formula VII:

(XTEN)-(S)$_x$(GH)-(S)$_y$-(GH)-(XTEN)     VII wherein independently for each occurrence, GH is a is a growth hormone; S is a spacer sequence having between 1 to about 50 amino acid residues that can optionally include a cleavage sequence; x is either 0 or 1; y is either 0 or 1; and XTEN is an extended recombinant polypeptide.

In another embodiment, the invention provides an isolated fusion protein, wherein the fusion protein is of formula VIII:

((S)$_m$-(GH)$_x$-(S)$_n$-(XTEN)$_y$-(S)$_o$)$_t$     VIII wherein t is an integer that is greater than 0 (1, 2, 3, etc.); independently each of m, n, o, x, and y is an integer (0, 1, 2, 3, etc.), GH is a is a growth hormone; S is an spacer, optionally comprising a cleavage site; and XTEN is an extended recombinant polypeptide, with the proviso that: (1) x+y>1, (2) when t=1, x>0 and y>0, (3) when there is more than one GH, S, or XTEN, each GH, XTEN, or S are the same or are independently different; and (4) when t>1, each m, n, o, x, or y within each subunit are the same or are independently different.

In some embodiments, administration of a therapeutically effective amount of a fusion protein of an embodiment of formulas I-VIII to a subject in need thereof results in a gain in time of at least two-fold, or at least three-fold, or at least four-fold, or at least five-fold, or at least 10-fold, or at least 20-fold, or at least 40-fold, or at least 100-fold or more spent within a therapeutic window for the fusion protein compared to the corresponding GH not linked to the XTEN of and administered at a comparable amount administered to a subject. In other embodiments, administration of a therapeutically effective dose of a fusion protein of an embodiment of formulas I-VIII to a subject in need thereof can result in a gain in time between consecutive doses necessary to maintain a therapeutically effective dose regimen of at least 48 h, or at least 72 h, or at least about 96 h, or at least about 120 h, or at least about 7 days, or at least about 14 days, or at least about 21 days between consecutive doses compared to a GH not linked to XTEN and administered at a comparable dose.

Any spacer sequence group is optional in the fusion proteins encompassed by the invention. The spacer is provided to enhance expression of the fusion protein from a host cell or to decrease steric hindrance such that the GH component may assume its desired tertiary structure and/or interact appropriately with its target receptor. For spacers and methods of identifying desirable spacers, see, for example, George, et al. (2003) Protein Engineering 15:871-879, specifically incorporated by reference herein. In one embodiment, the spacer comprises one or more peptide sequences that are between 1-50 amino acid residues in length, or about 1-25 residues, or about 1-10 residues in length. Spacer sequences, exclusive of cleavage sites, can comprise any of the 20 natural L amino acids, and will preferably comprise hydrophilic amino acids that are sterically unhindered that can include, but not be limited to, glycine (G), alanine (A), serine (S), threonine (T), glutamate (E) and proline (P). In some cases, the spacer can be polyglycines or polyalanines, or is predominately a mixture of combinations of glycine and alanine residues. The spacer polypeptide exclusive of a cleavage sequence is largely to substantially devoid of secondary structure; e.g., less than about 10%, or less than about 5% as determined by the Chou-Fasman and/or GOR algorithms. In one embodiment, one or both spacer sequences in a GHXTEN fusion protein composition each further contains a cleavage sequence, which are identical or different, wherein the cleavage sequence may be acted on by a protease to release the GH from the fusion protein.

In some embodiments, the incorporation of the cleavage sequence into the GHXTEN is designed to permit release of a GH that becomes active or more active upon its release from the XTEN. The cleavage sequences are located sufficiently close to the GH sequences, generally within 18, or within 12, or within 6, or within 2 amino acids of the GH sequence terminus, such that any remaining residues attached to the GH after cleavage do not appreciably interfere with the activity (e.g., such as binding to a receptor) of the GH, yet provide sufficient access to the protease to be able to effect cleavage of the cleavage sequence. In some embodiments, the cleavage site is a sequence that can be cleaved by a protease endogenous to the mammalian subject such that the GHXTEN can be cleaved after administration to a subject. In such cases, the GHXTEN can serve as a prodrug or a circulating depot for the GH. Examples of cleavage sites contemplated by the invention include, but are not limited to, a polypeptide sequence cleavable by a mammalian endogenous protease selected from FXIa, FXIIa, kallikrein, FVIIa, FIXa, FXa, FIIa (thrombin), Elastase-2, granzyme B, MMP-12, MMP-13, MMP-17 or MMP-20, or when coagulation is required physiologically, thereby releasing GH over time. Similarly, incorporation of other sequences into GHXTEN that are acted upon by endogenous proteases would provide for sustained release of GH that, in certain embodiments, provide a higher degree of activity for the GH from the "prodrug" form of the GHXTEN.

In some embodiments, only the two or three amino acids flanking both sides of the cut site (four to six amino acids total) are incorporated into the cleavage sequence. In other embodiments, the known cleavage sequence have one or more deletions or insertions or one or two or three amino acid substitutions for any one or two or three amino acids in the known sequence, wherein the deletions, insertions or substitutions result in reduced or enhanced susceptibility but not an absence of susceptibility to the protease, resulting in an ability to tailor the rate of release of the GH from the XTEN. Exemplary substitutions are shown in Table 6.

TABLE 6

Protease Cleavage Sequences

| Protease Acting Upon Sequence | Exemplary Cleavage Sequence | SEQ ID NO: | Minimal Cut Site* | |
|---|---|---|---|---|
| FXIa | KLTR↓VVGG | 84 | KD/FL/T/R↓VA/VE/GT/GV | |
| FXIIa | TMTR↓IVGG | 85 | NA | |
| Kallikrein | SPFR↓STGG | 86 | —/—/FL/RY↓SR/RT/—/— | |
| FVIIa | LQVR↓IVGG | 87 | NA | |
| FIXa | PLGR↓IVGG | 88 | —/—/G/R↓—/—/—/— | |
| FXa | IEGR↓TVGG | 89 | IA/E/GFP/R↓STI/VFS/—/G | |
| FIIa (thrombin) | LTPR↓SLLV | 90 | —/—/PLA/R↓SAG/—/—/— | |
| Elastase-2 | LGPV↓SGVP | 91 | —/—/—/VIAT↓—/—/—/— | |
| Granzyme-B | VAGD↓SLEE | 92 | V/—/—/D↓—/—/—/— | |
| MMP-12 | GPAG↓LGGA | 93 | G/PA/—/G↓L/—/G/— | 94 |
| MMP-13 | GPAG↓LRGA | 95 | G/P/—/G↓L/—/GA/— | 96 |
| MMP-17 | APLG↓LRLR | 97 | —/PS/—/—↓LQ/—/LT/— | |
| MMP-20 | PALP↓LVAQ | 98 | NA | |
| TEV | ENLYFQ↓G | 99 | ENLYFQ↓G/S | 100 |
| Enterokinase | DDDK↓IVGG | 101 | DDDK↓IVGG | 102 |
| Protease 3C (PreScission™) | LEVLFQ↓GP | 103 | LEVLFQ↓GP | 104 |
| Sortase A | LPKT↓GSES | 105 | L/P/KEAD/T↓G/—/EKS/S | 106 |

↓ indicates cleavage site
NA: not applicable
*the listing of multiple amino acids before, between, or after a slash indicate alternative amino acids that can be substituted at the position;
"—" indicates that any amino acid may be substituted for the corresponding amino acid indicated in the middle column by non-mammalian proteases such as TEV, enterokinase, PreScission™ protease (rhinovirus 3C protease), and sortase A. Sequences known to be cleaved by the foregoing proteases and others are known in the art. Exemplary cleavage sequences and cut sites within the sequences are presented in Table 6, as well as sequence variants thereof. For example, thrombin (activated clotting factor II) acts on the sequence LTPRSLLV (SEQ ID NO: 82) [Rawlings N. D., et al. (2008) Nucleic Acids Res., 36: D320], which would be cut after the arginine at position 4 in the sequence. Active FIIa is produced by cleavage of FIT by FXa in the presence of phospholipids and calcium and is down stream from factor IX in the coagulation pathway. Once activated its natural role in coagulation is to cleave fibrinogen, which then in turn, begins clot formation. FIIa activity is tightly controlled and only occurs when coagulation is necessary for proper hemostasis. However, as coagulation is an ongoing process in mammals, by incorporation of the LTPRSLLV sequence (SEQ ID NO: 83) into the GHXTEN between the GH and the XTEN, the XTEN domain would be removed from the adjoining GH concurrent with activation of either the extrinsic or intrinsic coagulation pathways In one embodiment, a GH incorporated into a GHXTEN fusion protein have a sequence that exhibits at least about 80% sequence identity to a sequence from Table 1, alternatively at least about 81%, or about 82%, or about 83%, or about 84%, or about 85%, or about 86%, or about 87%, or about 88%, or about 89%, or about 90%, or about 91%, or about 92%, or about 93%, or about 94%, or about 95%, or about 96%, or about 97%, or about 98%, or about 99%, or about 100% sequence identity as compared with a sequence from Table 1. The GH of the foregoing embodiment can be evaluated for activity using assays or measured or determined parameters as described herein, and those sequences that retain at least about 40%, or about 50%, or about 55%, or about 60%, or about 70%, or about 80%, or about 90%, or about 95% or more activity compared to the corresponding native GH sequence would be considered suitable for inclusion in the subject GHXTEN. The GH found to retain a suitable level of activity can be linked to one or more XTEN polypeptides described hereinabove. In one embodiment, a GH found to retain a suitable level of activity can be linked to one or more XTEN polypeptides having at least about 80% sequence identity to a sequence from Table 3, alternatively at least about 81%, 82%, 83%, 84%, 85%, 86%, 87%, 88%, 89%, 90%, 91%, 92%, 93%, 94%, 95%, 96%, 97%, 98%, 99%, or about 100% sequence identity as compared with a sequence of Table 3, resulting in a chimeric fusion protein.

Non-limiting examples of sequences of fusion proteins containing a single GH linked to a single XTEN are presented in Table 35. In one embodiment, a GHXTEN composition would comprise a fusion protein having at least about 80% sequence identity to a GHXTEN from Table 35, alternatively at least about 81%, 82%, 83%, 84%, 85%, 86%, 87%, 88%, 89%, 90%, 91%, 92%, 93%, 94%, 95%, 96%, 97%, 98%, 99%, or about 100% sequence identity as compared with a GHXTEN from Table 35. Non-limiting examples of sequences of fusion proteins containing two molecules of XTEN linked to one or more GH are presented in Table 36, but the invention also contemplates substitution of other GH with sequences exhibiting at least about 90% sequence identity to a sequence selected from Table 1 linked to one or two XTEN, which may be the same or different, exhibiting at least about 90% sequence identity selected from Table 3. In the foregoing fusion proteins hereinabove described in this paragraph, the GHXTEN fusion protein can further comprise a cleavage sequence from Table 6; the cleavage sequence being located between the GH and the XTEN or between adjacent GH (if more than one GH is included in the GHXTEN). In some cases, the GHXTEN comprising the cleavage sequences will also have one or more spacer sequence amino acids between the GH and the cleavage sequence or the XTEN and the cleavage sequence to facilitate access of the protease; the spacer amino acids comprising any natural amino acid, including glycine and alanine as preferred amino acids. Non-limiting examples of GHXTEN comprising GH, XTEN, cleavage sequence(s) and spacer amino acids are presented in Table 37. However, the invention also contemplates substitution of any of the GH sequences of Table 1 for a GH sequence of Table 37, substitution of any XTEN sequence of Table 3 for an XTEN sequence of Table 37, and substitution of any cleavage sequence of Table 6 for a cleavage sequence of Table 37.

(b) Pharmacokinetic Properties of GHXTEN

The invention provides GHXTEN fusion proteins with enhanced pharmacokinetics compared to the GH not linked to XTEN that, when used at the dose determined for the composition by the methods described herein, can achieve a circulating concentration resulting in a pharmacologic effect, yet stay within the safety range for biologically active component of the composition for an extended period of time compared to a comparable dose of the GH not linked to XTEN. In such cases, the GHXTEN remains within the therapeutic window for the fusion protein composition for the extended period of time. As used herein, a "comparable dose" means a dose with an equivalent moles/kg for the active GH pharmacophore that is administered to a subject in a comparable fashion. It will be understood in the art that a "comparable dosage" of GHXTEN fusion protein would represent a greater weight of agent but would have essentially the same mole-equivalents of GH in the dose of the fusion protein and/or would have the same approximate molar concentration relative to the GH.

The pharmacokinetic properties of a GH that can be enhanced by linking a given XTEN to the GH include terminal half-life, area under the curve (AUC), $C_{max}$ volume of distribution, and bioavailability providing enhanced utility in the treatment of growth hormone-related disorders, diseases and related conditions. The GH of the GHXTEN compositions can be a sequence that exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity to a protein sequence selected from Table 1, linked to one or more XTEN that exhibit at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity to a protein sequence selected from Table 3.

As described more fully in the Examples pertaining to pharmacokinetic characteristics of fusion proteins comprising XTEN, it was surprisingly discovered that increasing the length of the XTEN sequence confers a disproportionate increase in the terminal half-life of a fusion protein comprising the XTEN. Accordingly, the invention provides GHXTEN fusion proteins comprising XTEN wherein the XTEN is selected to provide a targeted half-life for the GHXTEN composition administered to a subject. In some embodiments, the invention provides monomeric fusion proteins comprising XTEN wherein the XTEN is selected to confer an increase in the terminal half-life for the GHXTEN administered to a subject, compared to the corresponding GH not linked to the fusion protein and administered at a comparable dose, of at least about two-fold longer, or at least about three-fold, or at least about four-fold, or at least about five-fold, or at least about six-fold, or at least about seven-fold, or at least about eight-fold, or at least about nine-fold, or at least about ten-fold, or at least about 15-fold, or at least a 20-fold, or at least a 40-fold, or at least a 80-fold, or at least a 100-fold or greater an increase in terminal half-life compared to the GH not linked to the fusion protein. Exogenously administered human growth hormone has been reported to have a terminal half-life in humans of less than 15 minutes (Hindmarch, P. C., et al., Clinical Endocrinology (2008) 30(4): 443-450), whereas various GHXTEN compositions disclosed herein that have been experimentally administered to various animals species, as described in the Examples, have resulted in terminal half-life values of several hours. Similarly, the GHXTEN fusion proteins can have an increase in AUC of at least about 50%, or at least about 60%, or at least about 70%, or at least about 80%, or at least about 90%, or at least about a 100%, or at least about 150%, or at least about 200%, or at least about 300%, or at least about 500%, or at least about 1000%, or at least about a 2000% increase in AUC compared to the corresponding GH not linked to the fusion protein and administered to a subject at a comparable dose. The pharmacokinetic parameters of a GHXTEN can be determined by standard methods involving dosing, the taking of blood samples at times intervals, and the assaying of the protein using ELISA, HPLC, radioassay, or other methods known in the art or as described herein, followed by standard calculations of the data to derive the half-life and other PK parameters.

The invention further provides GHXTEN comprising a first and a second GH molecule, optionally separated by a spacer sequence that may further comprise a cleavage sequence, or separated by a second XTEN sequence. In one embodiment, the GH has less activity when linked to the fusion protein compared to a corresponding GH not linked to the fusion protein. In such case, as illustrated in FIG. 38, the GHXTEN is designed such that upon administration to a subject, the GH component is gradually released by cleavage of the cleavage sequence(s), whereupon it regains activity or the ability to bind to its target receptor or ligand. Accordingly, the GHXTEN of the foregoing serves as a prodrug or a circulating depot, resulting in a longer terminal half-life compared to GH not linked to the fusion protein.

(c) Pharmacology and Pharmaceutical Properties of GHXTEN

The present invention provides GHXTEN compositions comprising GH covalently linked to XTEN that can have enhanced properties compared to GH not linked to XTEN, as well as methods to enhance the therapeutic and/or biologic activity or effect of the respective two GH components of the compositions. In addition, the invention provides GHXTEN compositions with enhanced properties compared to those art-known fusion proteins containing immunoglobulin polypeptide partners, polypeptides of shorter length and/or polypeptide partners with repetitive sequences. In addition, GHXTEN fusion proteins provide significant advantages over chemical conjugates, such as pegylated constructs, notably the fact that recombinant GHXTEN fusion proteins can be made in bacterial cell expression systems, which can reduce time and cost at both the research and development and manufacturing stages of a product, as well as result in a more homogeneous, defined product with less toxicity for both the product and metabolites of the GHXTEN compared to pegylated conjugates.

As therapeutic agents, the GHXTEN possesses a number of advantages over therapeutics not comprising XTEN including one or more of the following non-limiting exemplary enhance properties; increased solubility, increased thermal stability, reduced immunogenicity, increased apparent molecular weight, reduced renal clearance, reduced proteolysis, reduced metabolism, enhanced therapeutic efficiency, a lower effective therapeutic dose, increased bioavailability, increased time between dosages capable of maintain blood levels within the therapeutic window for the GH, a "tailored" rate of absorption, enhanced lyophilization stability, enhanced serum/plasma stability, increased terminal half-life, increased solubility in blood stream, decreased binding by neutralizing antibodies, decreased receptor-mediated clearance, reduced side effects, retention of receptor/ligand binding affinity or receptor/ligand activation, stability to degradation, stability to freeze-thaw, stability to proteases, stability to ubiquitination, ease of administration, compatibility with other pharmaceutical excipients or carriers, persistence in the subject, increased stability in storage (e.g., increased shelf-life), reduced toxicity in an organism or environment and the like. The net effect of the enhanced properties is that the GHXTEN results in enhanced therapeutic and/or biologic effect or improved patient compliance when administered to a subject with a growth hormone-related disease or disorder.

Specific assays and methods for measuring the physical and structural properties of expressed proteins are known in the art, including methods for determining properties such as protein aggregation, solubility, secondary and tertiary structure, melting properties, contamination and water content, etc. Such methods include analytical centrifugation, EPR, HPLC-ion exchange, HPLC-size exclusion, HPLC-reverse phase, light scattering, capillary electrophoresis, circular dichroism, differential scanning calorimetry, fluorescence, HPLC-ion exchange, HPLC-size exclusion, IR, NMR, Raman spectroscopy, refractometry, and UV/Visible spectroscopy. Additional methods are disclosed in Arnau et al, Prot Expr and Purif (2006) 48, 1-13. Application of these methods to the invention would be within the grasp of a person skilled in the art.

In a particular feature of the invention, XTEN as a fusion partner increases the solubility of the GH payload, particularly in the expression of GH, which is typically expressed as insoluble inclusion bodies in transformed host cells, such as *E. coli* (see, e.g., Singh, S. M., et al. (2005) *J Biosci Bioeng*, 99: 303; Patra, A. K., et al. (2000) *Protein Expr Purif*, 18: 182). Accordingly, where enhancement of the pharmaceutical or physicochemical properties of the GH is desirable, such as the degree of aqueous solubility or stability, the length and/or the motif family composition of the first and the second XTEN sequences of the first and the second fusion protein may each be selected to confer a different degree of solubility and/or stability on the respective fusion proteins such that the overall pharmaceutical properties of the GHXTEN composition are enhanced. The GHXTEN fusion proteins can be constructed and assayed, using methods described herein, to confirm the physicochemical properties and the XTEN adjusted, as needed, to result in the desired properties. In one embodiment, the XTEN sequence of the GHXTEN is selected such that the fusion protein has an aqueous solubility that is within at least about 25% greater compared to a GH not linked to the fusion protein, or at least about 30%, or at least about 40%, or at least about 50%, or at least about 75%, or at least about 100%, or at least about 200%, or at least about 300%, or at least about 400%, or at least about 500%, or at least about 1000% greater than the corresponding GH not linked to the fusion protein.

The invention provides methods to produce and recover expressed GHXTEN from a host cell with enhanced solubility and ease of recovery compared to GH not linked to XTEN. In some embodiments, the method includes the steps of transforming a prokaryotic host cell (e.g, *E. coli*) with a polynucleotide encoding a GHXTEN with one or more XTEN components of cumulative sequence length greater than about 800, or greater than about 900, or greater than about 1000, or greater than about 1100 amino acid residues, expressing the GHXTEN fusion protein in the host cell, lysing the host cell to recover cytoplasmic contents, and acidifying the host cell cytoplasmic contents wherein the GH can remain in soluble form while the majority of host cell proteins are precipitated to insoluble form. In one embodiment of the foregoing, the post-expression crude host cell lysates can be acidified to a pH of less than about 5.0, or to a pH of less than about 4.7, or to a pH of less than about 4.5, or to a pH of less than about 4.2 and greater than about 50%, or about 60%, or about 70%, or about 80% or more of the expressed GH can be recovered in soluble form. In a feature of the foregoing embodiment, enriched GHXTEN can be separated from precipitated from host cell protein contaminants by centrifugation of the acidified lysate, a reflection of the increased solubility imparted to the GH by fusion to the XTEN carrier. In the embodiments hereinabove described in this paragraph, the XTEN of the GHXTEN fusion proteins can have at least about 80% sequence identity, or about 90%, or about 91%, or about 92%, or about 93%, or about 94%, or about 95%, or about 96%, or about 97%, or about 98%, or about 99%, to about 100% sequence identity to one or more XTEN selected from Table 3 and the GH can have at least about 80% sequence identity, or about 90%, or about 91%, or about 92%, or about 93%, or about 94%, or about 95%, or about 96%, or about 97%, or about 98%, or about 99%, or 100% sequence identity to a GH selected from Table 1 and the GHXTEN components can be in an N- to C-terminus configuration selected from Table 5.

In one embodiment, the invention provides GHXTEN compositions and methods to produce the compositions that can maintain the GH component within a therapeutic window for a greater period of time compared to comparable dosages of the corresponding GH not linked to XTEN. It will be understood in the art that a "comparable dosage" of GHXTEN fusion protein would represent a greater weight of agent but would have the same approximate mole-equivalents of GH in the dose of the fusion protein and/or would have the same approximate molar concentration relative to the GH. The method to produce the compositions that can maintain the GH component within a therapeutic window includes the steps of selecting the XTEN appropriate for conjugation to a GH to provide the desired pharmacokinetic properties in view of a given dose and dose regiment, followed by assays to verify the pharmacokinetic properties, the activity of the GHXTEN fusion protein, and the safety of the administered composition. By the methods, GHXTEN can be produced that enables increased efficacy of the administered composition by maintaining the circulating concentrations of the GH within the therapeutic window for an enhanced period of time. As used herein, "therapeutic window" means that the amount of drug or biologic as a blood or plasma concentration range, which provides efficacy or a desired pharmacologic effect over time for the disease or condition without unacceptable toxicity, i.e. the range of the circulating blood concentrations between the minimal amount to achieve any positive therapeutic effect and the maximum amount which results in a response that is the response immediately before toxicity to the subject (at a higher dose or concentration). Additionally, therapeutic window generally encompasses an aspect of time; the maximum and minimum concentration that results in a desired pharmacologic effect over time that does not result in unacceptable toxicity or adverse events. A dosed composition that stays within the therapeutic window for the subject could also be said to be within the "safety range."

The characteristics of GHXTEN compositions of the invention, including functional characteristics or biologic and pharmacologic activity and parameters that result, are determined by any suitable screening assay known in the art for measuring the desired characteristic. The invention provides methods to assay the GHXTEN fusion proteins of differing composition or configuration in order to provide GHXTEN with the desired degree of biologic and/or therapeutic activity, as well as safety profile. Specific in vivo and ex vivo biological assays are used to assess the activity of each configured GHXTEN and/or GH component to be incorporated into GHXTEN, including but not limited to the assays of the Examples, those assays of Table 34, as well as the following assays or other such assays known in the art for assaying the properties and effects of GH. Assays can be conducted that allow determination of binding characteristics of the GHXTEN for GH receptors or a ligand, including binding constant ($K_d$), $EC_{50}$ values, as well as their half-life of dissociation of the ligand-receptor complex ($T_{1/2}$). Binding affinity can be measured, for example, by a competition-type binding assay that detects changes in the ability to specifically bind to a receptor or ligand (see, e.g., Examples). Additionally, techniques such as flow cytometry or surface plasmon resonance can be used to detect binding events. The assays may comprise soluble receptor molecules, or may determine the binding to cell-expressed receptors. Such assays may include cell-based assays, including assays for proliferation, cell death, apoptosis and cell migration. Other possible assays may determine receptor binding of expressed polypeptides, wherein the assay may comprise soluble receptor molecules, or may determine the binding to cell-expressed receptors. The binding affinity of a GHXTEN for the target receptors or ligands of the corresponding GH can be assayed using binding or competitive binding assays, such as Biacore assays with chip-bound receptors or binding proteins or ELISA assays, as described in U.S. Pat. No. 5,534,617, assays described in the Examples herein, radio-receptor assays, or other assays known in the art. In addition, GH sequence variants (assayed as single components or as GHXTEN fusion proteins) can be compared to the native GH using a competitive ELISA binding assay to determine whether they have the same binding specificity and affinity as the native GH, or some fraction thereof such that they are suitable for inclusion in GHXTEN. Functional assays can include the increase of IGF-1 secretion and/or generation within target cells as a result of exposure to GHXTEN, and/or the resulting stimulatory effects of IGF-1 on osteoblast and chondrocyte activity to promote bone growth; all are suitable parameters to assess the activity of GH for inclusion in the GHXTEN fusion protein or the resulting GHXTEN. In addition, human growth hormone (hGH) is known to play a role in somatic growth through its effects on the metabolism of proteins, carbohydrates and lipids, as well as the stimulation of the production of blood cells in vitro (Derfalvi et al., 1998; Merchav et al; 1988), to increase numbers of erythrocytes and hemoglobin content in blood (Valerio et al., 1997; Vihervuori et al., 1996), as wells as the enhancement of proliferation of and Ig production in plasma cell lines (Kimata and Yoshida, 1994), the stimulation of $CD8^+$ cell counts and, to a lesser extent $CD4^+$ cell counts (Geffner, 1997). Parameters that can be measured chronically include velocity of growth, physical maturation, and comparative bone rate of growth. All of the foregoing can be used to assess the activity of GH components to be incorporated into GHXTEN and the resulting GHXTEN.

Dose optimization is important for all drugs, especially for those with a narrow therapeutic window. For example, a standardized single dose of GH for all patients presenting with a diverse symptoms or abnormal clinical parameters may not always be effective. A consideration of these factors is well within the purview of the ordinarily skilled clinician for the purpose of determining the therapeutically or pharmacologically effective amount of the GHXTEN, versus that amount that would result in unacceptable toxicity and place it outside of the safety range, or insufficient potency such that clinical improvement is not achieved.

In many cases, the therapeutic window for GH in subjects of different ages or degree of disease have been established and are available in published literature or are stated on the drug label for approved products containing the GH. In other cases, the therapeutic window can be established for new compositions, including those GHXTEN of the disclosure. The methods for establishing the therapeutic window for a given composition are known to those of skill in the art (see, e.g., Goodman & Gilman's The Pharmacological Basis of Therapeutics, $11^{th}$ Edition, McGraw-Hill (2005)). For example, by using dose-escalation studies in subjects with the target disease or disorder to determine efficacy or a desirable pharmacologic effect, appearance of adverse events, and determination of circulating blood levels, the therapeutic window for a given subject or population of subjects can be determined for a given drug or biologic, or combinations of biologics or drugs. The dose escalation studies can evaluate the activity of a GHXTEN through metabolic studies in a subject or group of subjects that monitor physiological or biochemical parameters, as known in the art or as described herein for one or more parameters associated with the metabolic disease or disorder, or clinical parameters associated with a beneficial outcome for the particular indication, together with observations and/or measured parameters to determine the no effect dose, adverse events, maximum tolerated dose and the like, together with measurement of pharmacokinetic parameters that establish the determined or derived circulating blood levels. The results can then be correlated with the dose administered and the blood concentrations of the therapeutic that are coincident with the foregoing determined parameters or effect levels. By these methods, a range of doses and blood concentrations can be correlated to the minimum effective dose as well as the maximum dose and blood concentration at which a desired effect occurs and above which toxicity occurs, thereby establishing the therapeutic window for the dosed therapeutic. Blood concentrations of the fusion protein (or as measured by the GH component) above the maximum would be considered outside the therapeutic window or safety range. Thus, by the foregoing methods, a $C_{min}$ blood level would be established, below which the GHXTEN fusion protein would not have the desired pharmacologic effect, and a $C_{max}$ blood level would be established that would represent the highest circulating concentration before reaching a concentration that would elicit unacceptable side effects, toxicity or adverse events, placing it outside the safety range for the GHXTEN. With such concentrations established, the frequency of dosing and the dosage can be further refined by measurement of the $C_{max}$ and $C_{min}$ to provide the appropriate dose and dose frequency to keep the fusion protein(s) within the therapeutic window. One of skill in the art can, by the means disclosed herein or by other methods known in the art, confirm that the administered GHXTEN remains in the therapeutic window for the desired interval or requires adjustment in dose or length or sequence of XTEN. Further, the determination of the appropriate dose and dose frequency to keep the GHXTEN within the therapeutic window establishes the therapeutically effective dose regimen; the schedule for administration of multiple consecutive doses using a therapeutically effective dose of the fusion protein to a subject in need thereof resulting in consecutive $C_{max}$ peaks and/or $C_{min}$ troughs that remain within the therapeutic window and results in an improvement in at least one measured parameter relevant for the target disease, disorder or condition. In some cases, the GHXTEN administered at an appropriate dose to a subject results in blood concentrations of the GHXTEN fusion protein that remains within the therapeutic window for a period at least about two-fold longer compared to the corresponding GH not linked to XTEN and administered at a comparable dose; alternatively at least about three-fold longer; alternatively at least about four-fold longer; alternatively at least about five-fold longer; alternatively at least about six-fold longer; alternatively at least about seven-fold longer; alternatively at least about eight-fold longer; alternatively at least about nine-fold longer or at least about ten-fold longer or greater compared to the corresponding GH not linked to XTEN and administered at a comparable dose. As used herein, an "appropriate dose" means a dose of a drug or biologic that, when administered to a subject, would result in a desirable therapeutic or pharmacologic effect and a blood concentration within the therapeutic window.

In one embodiment, the GHXTEN administered at a therapeutically effective dose regimen results in a gain in time of at least about three-fold longer; alternatively at least about four-fold longer; alternatively at least about five-fold longer; alternatively at least about six-fold longer; alternatively at least about seven-fold longer; alternatively at least about eight-fold longer; alternatively at least about nine-fold longer or at least about ten-fold longer between at least two consecutive $C_{max}$ peaks and/or $C_{min}$ troughs for blood levels of the fusion protein compared to the corresponding biologically active protein of the fusion protein not linked to the fusion protein and administered at a comparable dose regimen to a subject. In another embodiment, the GHXTEN administered at a therapeutically effective dose regimen results in a comparable improvement in one, or two, or three or more measured parameter using less frequent dosing or a lower total dosage in moles of the fusion protein of the pharmaceutical composition compared to the corresponding biologically active protein component(s) not linked to the fusion protein and administered to a subject using a therapeutically effective dose regimen for the GH. The measured parameters include any of the clinical, biochemical, or physiological parameters disclosed herein, or others known in the art for assessing subjects with growth hormone-related disorders.

The invention provides isolated GHXTEN in which the binding affinity for GH target receptors or ligands by the GHXTEN can be at least about 10%, or at least about 20%, or at least about 30%, or at least about 40%, or at least about 50%, or at least about 60%, or at least about 70%, or at least about 80%, or at least about 90%, or at least about 95%, or at least about 99%, or at least about 100% or more of the affinity of a native GH not bound to XTEN for the target receptor or ligand. In some cases, the binding affinity $K_d$ between the subject GHXTEN and a native receptor or ligand of the GHXTEN is at least about $10^{-4}$ M, alternatively at least about $10^{-5}$ M, alternatively at least about $10^{-6}$ M, or at least about $10^{-7}$ M, or at least about $10^{-8}$ M, or at least about $10^{-9}$ M of the affinity between the GHXTEN and a native receptor or ligand.

In other embodiments, the invention provides isolated GHXTEN fusion proteins specifically designed to have reduced binding affinity to the GH receptor. In one embodiments, such as fusion proteins comprising an XTEN fused to the C-terminus of the GH 1 about 97% sequence identity, or at least about 99% sequence identity to GH fusion proteins selected from AE912-hGH-AE144, AE912-hGH-AF144, AE912-hGH-AE288, AM923-hGH-AE144, AM923-hGH-AF144, AM923-hGH-AE288, and the sequences of Tables 36-37.

In some embodiments, the GHXTEN fusion proteins of the invention retain at least about 0.05%, or about 0.1%, or about 1%, or about 10%, or about 20%, or about 30%, or about 40%, or about 50%, or about 60%, or about 70%, or about 80%, or about 90%, or about 95%, or about 98%, or or about 99% percent of the biological activity of the corresponding GH not linked to the fusion protein with regard to an in vitro biologic activity or pharmacologic effect known or associated with the use of the native GH in the treatment and prevention of growth hormone-related diseases, disorder and conditions. Non-limiting examples of activities or pharmacologic effects that can be assayed to assess the retained activity of the GHXTEN fusion proteins include signal transduction markers in cells with GH receptors, elicited IGF-1 concentrations, elicited IGFBP3 concentrations, changes in height velocity, lean body mass, total body fat, trunk fat, parameters associated with insulin resistance syndrome, measurement of division and multiplication rates of chondrocytes, changes in bone density, and bone growth (e.g. increase in epiphyseal plate width). In some embodiments, the activity of the GH component is manifest by the intact GHXTEN fusion protein, while in other cases the activity of the GH component would be primarily manifested upon cleavage and release of the GH from the fusion protein by action of a protease that acts on a cleavage sequence incorporated into the GHXTEN fusion protein. In the foregoing, the GHXTEN is designed to reduce the binding affinity of the GH component for the receptor or ligand when linked to the XTEN but have restored or increased affinity when released from XTEN through the cleavage of cleavage sequence(s) incorporated into the GHXTEN sequence, as described more fully above.

In other cases, the GHXTEN can be designed to reduce the binding affinity of the GH component to the GH receptor to increase the terminal half-life of GHXTEN administered to a subject by reducing receptor-mediated clearance; e.g., by adding an XTEN to the C-terminus of the GH component of the fusion protein. In other cases, the GHXTEN are designed to reduce the binding affinity of the GH component to the GH receptor to reduce toxicity or side effects due to the administered composition.

Figures 3, 3A, 3B:
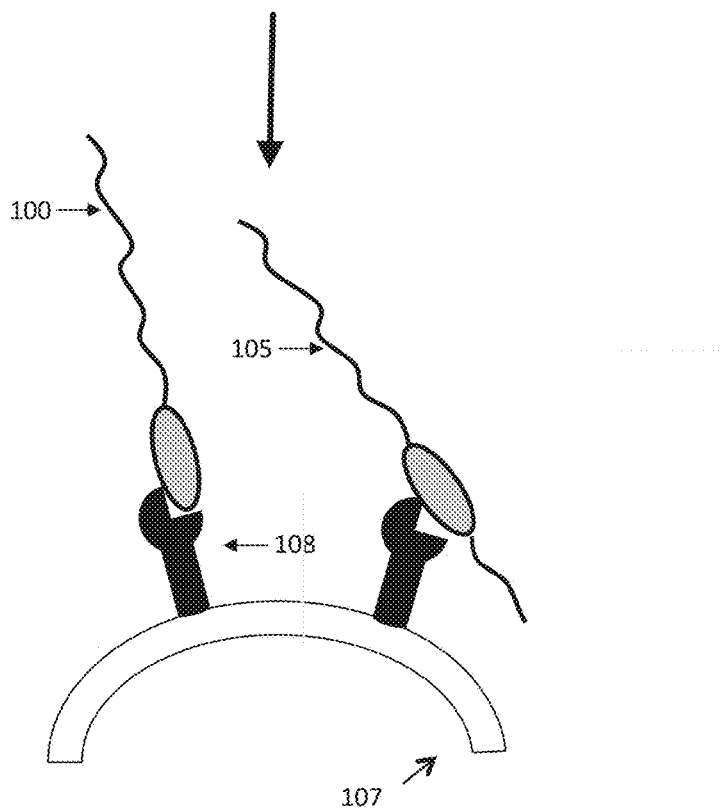
FIG. 3 is a schematic illustration of two exemplary monomeric GHXTEN and the ability of the monomeric fusion proteins to bind to a target receptor on a cell surface, with subsequent cell signaling.
FIG. 3A shows a GHXTEN fusion protein (100) consisting of a GH (103) and an XTEN (102) and a second GHXTEN fusion protein (105) consisting of a GH linked to two XTEN (105).
FIG. 3B shows the interaction of the GHXTEN with the GH on the C-terminus (100) and the GHXTEN with an XTEN on the C-terminus (105) with target receptors (108) to GH on a cell surface (107). In this case, binding to the receptor with high affinity is exhibited when GH has a free C-terminus, while the GHXTEN with a C-terminal XTEN does not bind tightly to the receptor, and disassociates, as seen in FIG. 3C.

Accordingly, the invention provides a method for increasing the terminal half-life of a GHXTEN by producing a single-chain fusion protein construct with a specific N- to C-terminus configuration of the components comprising at least a first GH and a first and a second XTEN, wherein the fusion protein in a first N- to C-terminus configuration of the GH and XTEN components has reduced receptor-mediated clearance (RMC) and a corresponding increase in terminal half-life compared to a GHXTEN in a second N- to C-terminus configuration. In one embodiment of the foregoing, the GHXTEN is configured, N- to C-terminus as XTEN-GH-XTEN, which has reduced receptor binding compared to a GHXTEN configures, N- to C-terminus XTEN-GH. In another embodiment of the foregoing, the GHXTEN is configured GH-XTEN. In the foregoing embodiments, the two XTEN molecules can be identical or they can be of a different sequence composition or length. Non-limiting examples of the foregoing embodiment with two XTEN linked to a single GH include the constructs AE912-hGH-AE144, AE912-hGH-AE288, AE864-hGH-AE144, AM923-hGH-AE144, and AM923-hGH-AE288. The invention contemplates other such constructs in which a GH from Table 1 and XTEN from Table 3 are substituted for the respective components of the foregoing examples, and are produced, for example, in a configuration from Table 5 such that the construct has reduced receptor mediated clearance compared to an alternative configuration of the respective components. In some embodiments, the foregoing method for increasing the terminal half-life provides configured GHXTEN that can result in an increase in the terminal half-life of at least about 30%, or about 50%, or about 75%, or about 100%, or about 150%, or about 200%, or about 300%, or about 400% or more compared to the half-life of a GHXTEN in a second configuration where receptor binding is not reduced. The invention takes advantage of the fact that certain ligands wherein reduced binding affinity to a receptor, either as a result of a decreased on-rate or an increased off-rate, may be effected by the obstruction of either the N- or C-terminus (as shown in FIG. 3), and using that terminus as the linkage to another polypeptide of the composition, whether another molecule of a GH, an XTEN, or a spacer sequence results in the reduced binding affinity. The choice of the particular configuration of the GHXTEN fusion protein reduces the degree of binding affinity to the receptor such that a reduced rate of receptor-mediated clearance is achieved. Generally, activation of the receptor is coupled to RMC such that binding of a polypeptide to its receptor without activation does not lead to RMC, while activation of the receptor leads to RMC. However, in some cases, particularly where the ligand has an increased off rate, the ligand may nevertheless be able to bind sufficiently to initiate cell signaling without triggering receptor mediated clearance, with the net result that the GHXTEN remains bioavailable. In such cases, the configured GHXTEN has an increased half-life compared to those configurations that lead to a higher degree of RMC.

In cases where a reduction in binding affinity to the growth hormone receptor is desired in order to reduce receptor-mediated clearance but retention of at least a portion of the biological activity is also desired, sufficient binding affinity to obtain the desired receptor activation must nevertheless be maintained e.g., by initiation of signal transduction. Thus, in one embodiment, the invention provides a GHXTEN configured such that the binding affinity of the GHXTEN for a target receptor is in the range of about 0.01%-40%, or about 0.01%-30%, or about 0.01%-20% of the binding affinity compared to a corresponding GHXTEN in a configuration wherein the binding affinity is not reduced. The binding affinity of the configured BXTEN is thus preferably reduced by at least about 60%, or at least about 70%, or at least about 80%, or at least about 90%, or at least about 95%, or at least about 99%, or at least about 99.99% as compared to the binding affinity of a corresponding GHXTEN in a configuration wherein the binding affinity of the GH component to the target receptor is not reduced or compared to the GH not linked to the fusion protein, determined under comparable conditions. Expressed differently, the GH component of the configured GHXTEN has a binding affinity that is as small as about 0.01%, or at least about 0.1%, or at least about 1%, or at least about 2%, or at least about 3%, or at least about 4%, or at least about 5%, or at least about 10%, or at least about 20%, or at least about 30%, or at least 40% of that of the corresponding GH component of a GHXTEN in a configuration wherein the binding affinity of the GH component is not reduced. In the foregoing embodiments, the binding affinity of the configured GHXTEN for the target receptor are "substantially reduced" compared to a corresponding native GH or a GHXTEN with a configuration in which the binding affinity of the corresponding GH component is not reduced. Accordingly, the present invention provides compositions and methods to produce compositions with reduced RMC by configuring the GHXTEN, examples of which are provided above, so as to be able to bind and activate a sufficient number of receptors to obtain a desired in vivo biological response yet avoid activation of more receptors than is required for obtaining such response. The increased half-life permits higher dosages and reduced frequency of dosing compared to GH not linked to XTEN or compared to GHXTEN configurations wherein the GH component retains sufficient biological or pharmacological activity to result in a composition with clinical efficacy maintained despite reduced dosing frequency.

VI). Uses of the Compositions of the Present Invention

In another aspect, the invention provides a method for achieving a beneficial effect in a disease, disorder or condition mediated by GH. The present invention addresses disadvantages and/or limitations of GH that have a relatively short terminal half-life and/or a narrow therapeutic window.

Most processes involved in growth of the body are regulated by multiple peptides and hormones, and such peptides and hormones, as well as analogues thereof, have found utility in the treatment of growth hormone-related diseases, disorders and conditions. However, the use of commercially-avaiable growth hormones, has met with less than optimal success in the management of subjects afflicted with such diseases, disorders and conditions. In particular, dose optimization and frequency of dosing is important for peptide and hormone biologics used in the treatment of growth hormone-related diseases and disorders. The fact that growth hormone has a short half-life, necessitates frequent dosing in order to achieve clinical benefit, which results in difficulties in the management of such patients.

In one embodiment, the invention provides a method for achieving a beneficial affect in a subject with a growth hormone-related disease, disorder or condition comprising the step of administering to the subject a therapeutically- or prophylactically-effective amount of a GHXTEN wherein said administration results in the improvement of one or more biochemical or physiological parameters or clinical endpoints associated with a growth hormone-related disease, disorder or condition. The effective amount produces a beneficial effect in helping to treat (e.g., cure or reduce the severity) or prevent (e.g., reduce the likelihood of onset or severity) a growth hormone-related disease, disorder or condition. In some cases, the method for achieving a beneficial effect includes administering a therapeutically effective amount of a GHXTEN fusion protein composition to treat a subject with a growth hormone-related disease, disorder, or condition, including, but not limited to, congenital or acquired GH deficiency in adults and children, Turner's Syndrome, Prader-Willi Syndrome, chronic renal failure, intrauterine growth retardation, idiopathic short stature, AIDS wasting, obesity, multiple sclerosis, aging, fibromyalgia, Crohn's disease, ulcerative colitis, muscular dystrophy, low muscle mass (e.g. bodybuilding), low bone density, or any other indication for which GH can be utilized (but for which endogenous growth hormone levels in a subject are not necessarily deficient).

In another embodiment, the invention provides a method of stimulating IGF-1 production in individuals with GH deficiency. The method comprises the step of administering therapeutically effective amount of GHXTEN to a subject that results in the increased blood levels and/or duration in increased blood levels of IGF-1 compared to a subject receiving a GH not linked to an XTEN and administered at a comparable dose. In some cases, the increase in IGF-1 is at least about 20%, or at least about 30%, or at least about 40%, or at least about 50%, or at least about 75%, or at least about 100%, or at least about 200%, or at least about 300%. In another embodiment, the invention provides a method of stimulating the division and numbers of chrondrocytes. The method comprises the step of administering therapeutically effective amount of GHXTEN that results in the increased production of chrondrocytes by at least about 20%, or at least about 30%, or at least about 40%, or at least about 50%, or at least about 75%, or at least about 100%, or at least about 200%, or at least about 300% compared to a subject receiving a GH not linked to an XTEN and administered at a comparable dose. In another embodiment, the invention provides a method comprising the step of administering therapeutically effective amount of GHXTEN that results in increased bone growth as measured by increase in epiphyseal plate width by at least about 20%, or at least about 30%, or at least about 40%, or at least about 50%, or at least about 75%, or at least about 100%, or at least about 200%, or at least about 300% compared to a subject receiving a GH not linked to an XTEN and administered at a comparable dose.

As a result of the enhanced PK parameters of GHXTEN, as described herein, the GH is administered using longer intervals between doses compared to the corresponding GH not linked to XTEN to prevent, treat, alleviate, reverse or ameliorate symptoms or clinical abnormalities of the growth hormone-related disease, disorder or condition or prolong the survival of the subject being treated.

The methods of the invention includes administration of consecutive doses of a therapeutically effective amount of the GHXTEN for a period of time sufficient to achieve and/or maintain the desired parameter or clinical effect, and such consecutive doses of a therapeutically effective amount establishes the therapeutically effective dose regimen for the GHXTEN; i.e., the schedule for consecutively administered doses of the fusion protein composition, wherein the doses are given in therapeutically effective amounts to result in a sustained beneficial effect on any clinical sign or symptom, aspect, measured parameter or characteristic of a metabolic disease state or condition, including, but not limited to, those described herein. In one embodiment, the method comprises administering a therapeutically-effective amount of a pharmaceutical composition comprising a GHXTEN fusion protein composition comprising a GH linked to an XTEN sequence(s) and at least one pharmaceutically acceptable carrier to a subject in need thereof that results in greater improvement in at least one parameter, physiologic condition, or clinical outcome mediated by the GH component(s) (non-limiting examples of which are described above) compared to the effect mediated by administration of a pharmaceutical composition comprising a GH not linked to XTEN and administered at a comparable dose. In one embodiment, the pharmaceutical composition is administered at a therapeutically effective dose. In another embodiment, the pharmaceutical composition is administered using multiple consecutive doses using a therapeutically effective dose regimen (as defined herein) for the length of the dosing period.

A therapeutically effective amount of the GHXTEN varies according to factors such as the disease state, age, sex, and weight of the individual, and the ability of the antibody or antibody portion to elicit a desired response in the individual. A therapeutically effective amount is also one in which any toxic or detrimental effects of the GHXTEN are outweighed by the therapeutically beneficial effects. A prophylactically effective amount refers to an amount of GHXTEN required for the period of time necessary to achieve the desired prophylactic result.

For the inventive methods, longer acting GHXTEN compositions are preferred, so as to improve patient convenience, to increase the interval between doses and to reduce the amount of drug required to achieve a sustained effect. In one embodiment, a method of treatment comprises administration of a therapeutically effective dose of a GHXTEN to a subject in need thereof that results in a gain in time spent within a therapeutic window established for the fusion protein of the composition compared to the corresponding GH component(s) not linked to the fusion protein and administered at a comparable dose to a subject. In some cases, the gain in time spent within the therapeutic window is at least about three-fold, or at least about four-fold, or at least about five-fold, or at least about six-fold, or at least about eight-fold, or at least about 10-fold, or at least about 20-fold, or at least about 40-fold, or at least about 80-fold, or at least about 100-fold longer, compared to the corresponding GH component not linked to the fusion protein and administered at a comparable dose to a subject. The methods further provide that administration of multiple consecutive doses of a GHXTEN administered using a therapeutically effective dose regimen to a subject in need thereof results in a gain in time between consecutive $C_{max}$ peaks and/or $C_{min}$ troughs for blood levels of the fusion protein compared to the corresponding GH not linked to the fusion protein and administered using a dose regimen established for that GH. In the foregoing embodiment, the gain in time spent between consecutive $C_{max}$ peaks and/or $C_{min}$ troughs is at least about three-fold, or at least about four-fold, or at least about five-fold, or at least about six-fold, or at least about eight-fold, or at least about 10-fold, or at least about 20-fold, or at least about 40-fold or at least about 80-fold, or at least about 100-fold longer, compared to the corresponding GH component not linked to the fusion protein and administered using a dose regimen established for that GH. In the embodiments hereinabove described in this paragraph the administration of the fusion protein results in an improvement in at least one of the parameters (disclosed herein as being useful for assessing the subject diseases, conditions or disorders) using a lower unit dose in moles of fusion protein compared to the corresponding GH component not linked to the fusion protein and administered at a comparable unit dose or dose regimen to a subject.

The method of treatment comprises administration of a GHXTEN using a therapeutically effective dose regimen to effect improvements in one or more parameters associated with growth hormone diseases, disorders or conditions. In some embodiments, administration of the GHXTEN to a subject results in an improvement in one or more of the biochemical, physiologic, or clinical parameters that is of greater magnitude than that of the corresponding GH component not linked to XTEN, determined using the same assay or based on a measured clinical parameter. In other embodiments, administration of the GHXTEN to a subject using a therapeutically effective dose regimen results in activity in one or more of the biochemical, physiologic, or clinical parameters that is of longer duration than the activity of one of the single GH components not linked to XTEN, determined using that same assay or based on a measured clinical parameter. In one embodiment of the foregoing, the administration of the GHXTEN to a subject using a therapeutically effective dose regimen results in an improvement in peak concentrations and area under the curve of blood IGF-1 levels of at least about 10%, or about 20%, or about 30%, or about 40%, or about 50%, or about 60%, or about 70%, or about 80%, or about 90%, or about 100% or more in the subject compared to a comparable dose of GH not linked to XTEN administered to a subject. In another embodiment of the foregoing, the administration of the GHXTEN to a subject using a therapeutically effective dose regimen results in increased weight gain in the subject of at least about 10%, or about 20%, or about 30%, or about 40%, or about 50% or more compared to a comparable dose regimen of GH not linked to XTEN administered to a subject.

The invention further contemplates that GHXTEN used in accordance with the methods provided herein is administered in conjunction with other treatment methods and pharmaceutical compositions useful for treating growth hormone-related diseases, disorders, and conditions, or conditions for which growth hormone is adjunctive therapy; e.g., insulin resistance and poor glycemic control. Such compositions, include for example, DPP-IV inhibitors, insulin, insulin analogues, PPAR gamma agonists, dual-acting PPAR agonists, GLP-1 agonists or analogues, PTP1B inhibitors, SGLT inhibitors, insulin secretagogues, RXR agonists, glycogen synthase kinase-3 inhibitors, insulin sensitizers, immune modulators, beta-3 adrenergic receptor agonists, Pan-PPAR agonists, 11beta-HSD1 inhibitors, biguanides, alpha-glucosidase inhibitors, meglitinides, thiazolidinediones, sulfonylureas and other diabetes medicants known in the art, or anti-hypertensive drugs, calcium channel blockers, and related products. In some embodiments, the administration of a GHXTEN permits use of lower dosages of the co-administered pharmaceutical composition to achieve a comparable clinical effect or measured parameter for the disease, disorder or condition in the subject.

In another aspect, the invention provides a method of designing the GHXTEN compositions with desired pharmacologic or pharmaceutical properties. The GHXTEN fusion proteins are designed and prepared with various objectives in mind (compared to the GH components not linked to the fusion protein), including improving the therapeutic efficacy for the treatment of growth hormone-related diseases, disorders, and conditions, enhancing the pharmacokinetic characteristics of the fusion proteins compared to the GH, lowering the dose or frequency of dosing required to achieve a pharmacologic effect, enhancing the pharmaceutical properties, and to enhance the ability of the GH components to remain within the therapeutic window for an extended period of time.

Figure 4:
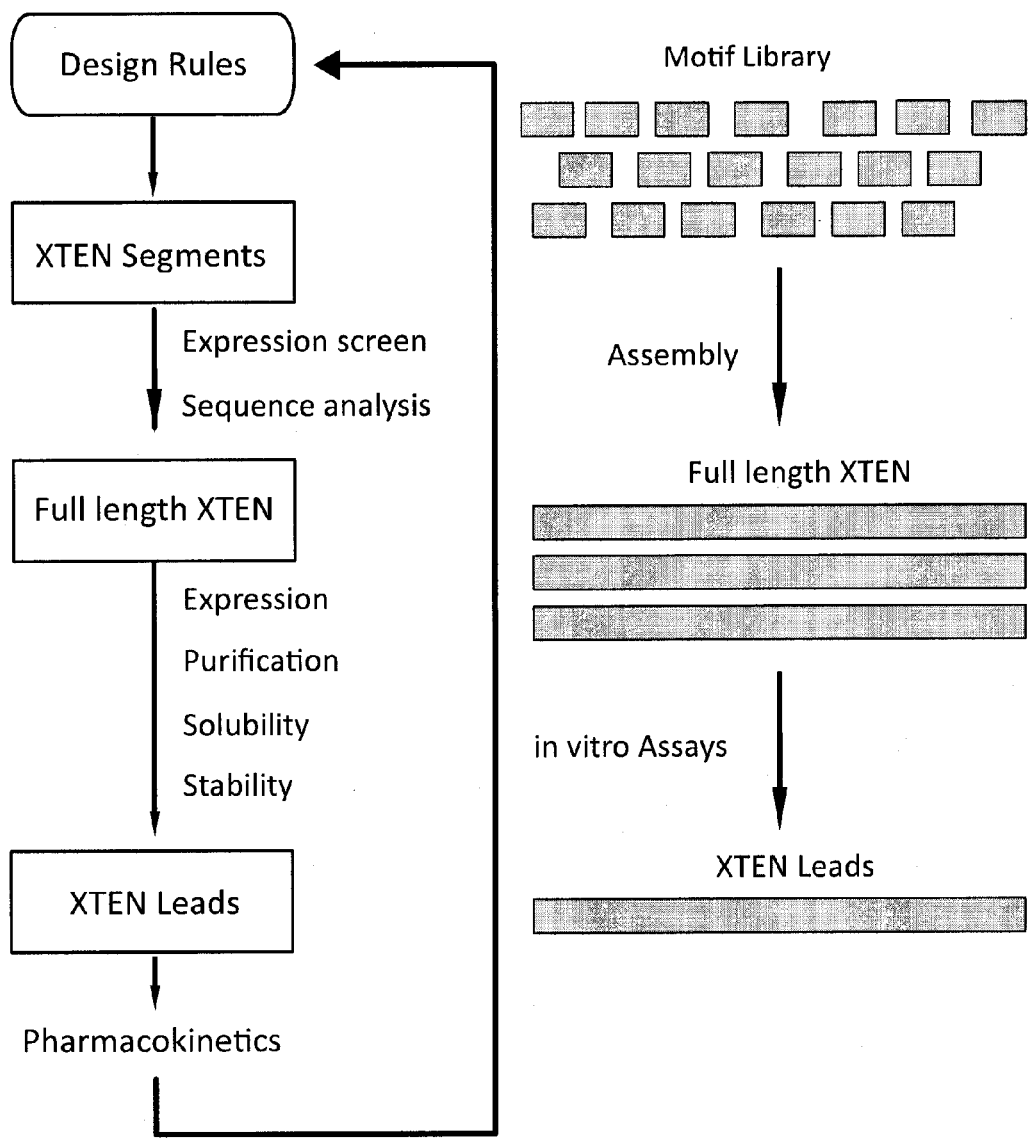
FIG. 4 is a schematic flowchart of representative steps in the assembly, production and the evaluation of a XTEN.
Figure 5:
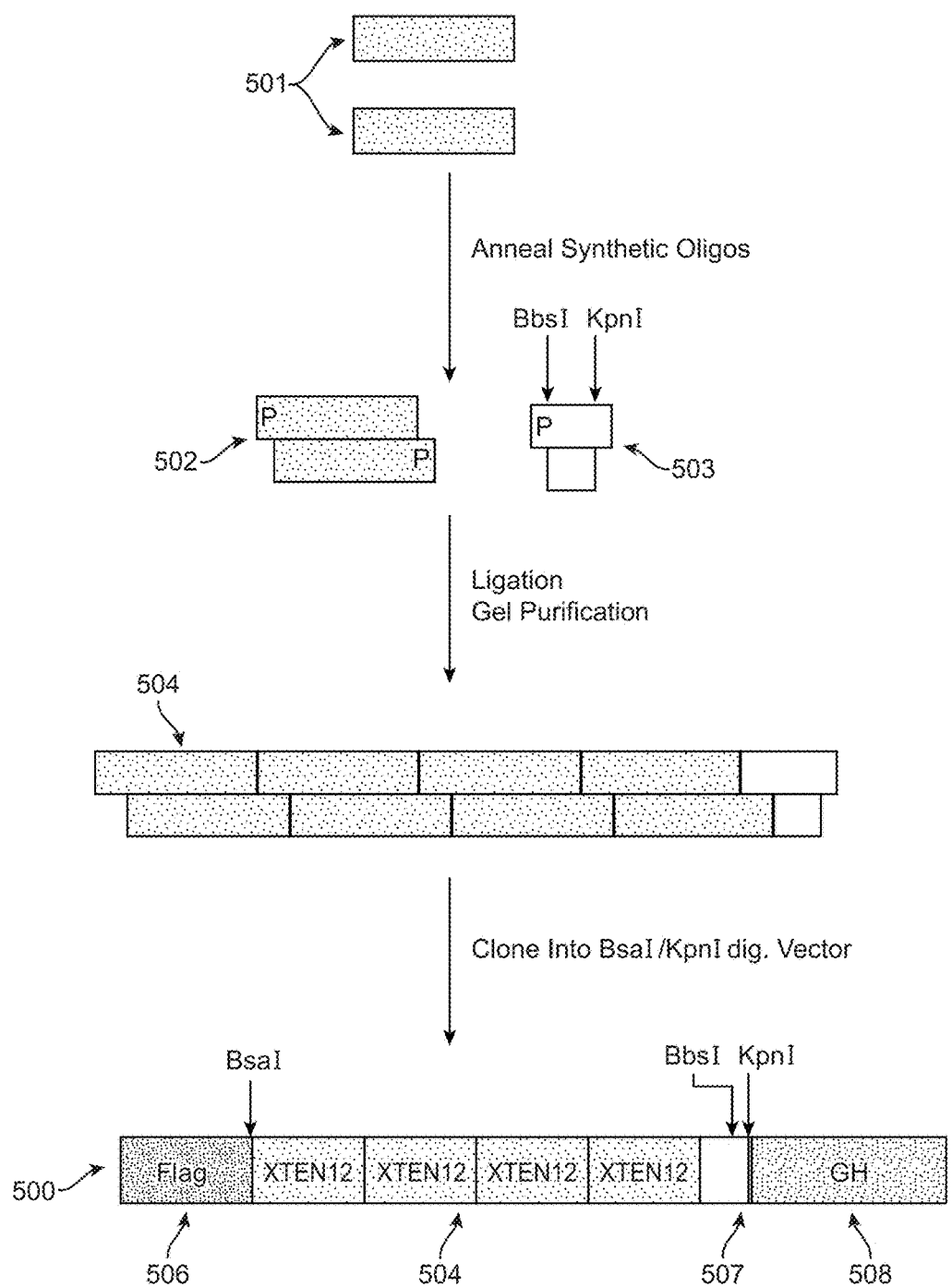
FIG. 5 is a schematic flowchart of representative steps in the assembly of a GHXTEN polynucleotide construct encoding a fusion protein. Individual oligonucleotides 501 are annealed into sequence motifs 502 such as a 12 amino acid motif ("12-mer"), which is subsequently ligated with an oligo containing BbsI, and KpnI restriction sites 503. Additional sequence motifs from a library are annealed to the 12-mer until the desired length of the XTEN gene 504 is achieved. The XTEN gene is cloned into a stuffer vector. The vector encodes a Flag sequence 506 followed by a stopper sequence that is flanked by BsaI, BbsI, and KpnI sites 507 and an exendin-4 gene 508, resulting in the gene 500 encoding an XTEN-GH fusion protein.
Figure 6:
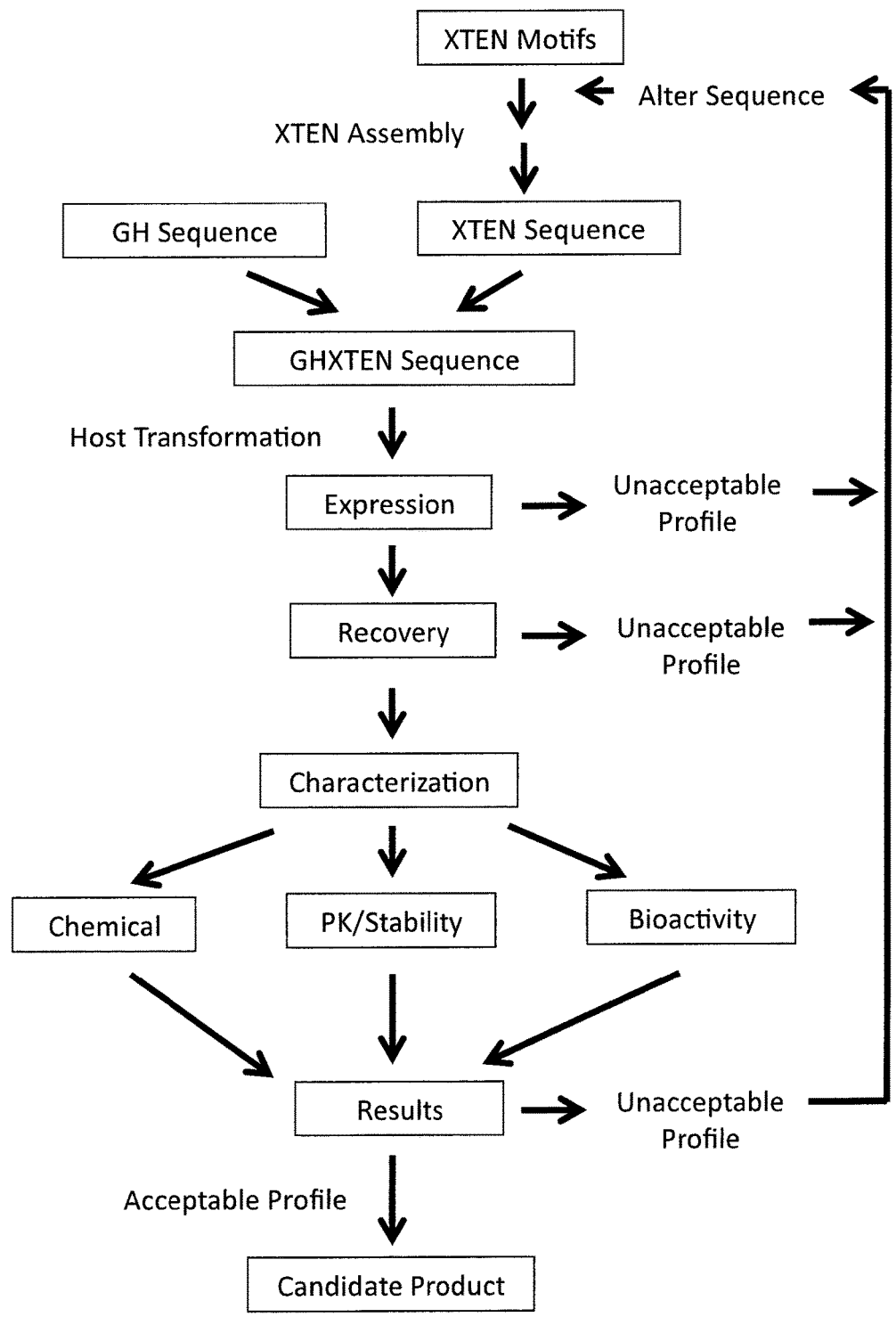
FIG. 6 is a schematic flowchart of representative steps in the assembly of a gene encoding fusion protein comprising a growth hormone (GH) and XTEN, its expression and recovery as a fusion protein, and its evaluation as a candidate GHXTEN product.

In general, the steps in the design and production of the fusion proteins and the inventive compositions, as illustrated in FIGS. 4-6, include: (1) the selection of GHs (e.g., native proteins, analogs or derivatives with activity) to treat the particular disease, disorder or condition; (2) selecting the XTEN that will confer the desired PK and physicochemical characteristics on the resulting GHXTEN (e.g., the administration of the composition to a subject results in the fusion protein being maintained within the therapeutic window for a greater period compared to GH not linked to XTEN); (3) establishing a desired N- to C-terminus configuration of the GHXTEN to achieve the desired efficacy or PK parameters; (4) establishing the design of the expression vector encoding the configured GHXTEN; (5) transforming a suitable host with the expression vector; and (6) expression and recovery of the resultant fusion protein. For those GHXTEN for which an increase in half-life (greater than 24 h) or an increased period of time spent within a therapeutic window is desired, the XTEN chosen for incorporation generally has at least about 500, or about 576, or about 864, or about 875, or about 912, or about 923 amino acid residues where a single XTEN is to be incorporated into the GHXTEN. In another embodiment, the GHXTEN comprises a first XTEN of the foregoing lengths, and a second XTEN of about 144, or about 288, or about 576, or about 864, or about 875, or about 912, or about 923 amino acid residues.

In other embodiments, where an increase in half-life is not required, but an increase in a pharmaceutical property (e.g., solubility) is desired, a GHXTEN is designed to include XTEN of shorter lengths. In some embodiments of the foregoing, the GHXTEN comprises a GH linked to an XTEN having at least about 24, or about 36, or about 48, or about 60, or about 72, or about 84, or about 96 amino acid residues, in which the solubility of the fusion protein under physiologic conditions is at least three-fold greater than the corresponding GH not linked to XTEN, or alternatively, at least four-fold, or five-fold, or six-fold, or seven-fold, or eight-fold, or nine-fold, or at least 10-fold, or at least 20-fold, or at least 30-fold, or at least 50-fold, or at least 60-fold or greater than GH not linked to XTEN. In one embodiment of the foregoing, the GH is human growth hormone.

In another aspect, the invention provides methods of making GHXTEN compositions to improve ease of manufacture, result in increased stability, increased water solubility, and/or ease of formulation, as compared to the native GH. In one embodiment, the invention includes a method of increasing the water solubility of a GH comprising the step of linking the GH to one or more XTEN such that a higher concentration in soluble form of the resulting GHXTEN can be achieved, under physiologic conditions, compared to the GH in an un-fused state. Factors that contribute to the property of XTEN to confer increased water solubility of GHs when incorporated into a fusion protein include the high solubility of the XTEN fusion partner and the low degree of self-aggregation between molecules of XTEN in solution. In some embodiments, the method results in a GHXTEN fusion protein wherein the water solubility is at least about 20%, or at least about 30% greater, or at least about 50% greater, or at least about 75% greater, or at least about 90% greater, or at least about 100% greater, or at least about 150% greater, or at least about 200% greater, or at least about 400% greater, or at least about 600% greater, or at least about 800% greater, or at least about 1000% greater, or at least about 2000% greater, or at least about 4000% greater, or at least about 6000% greater under physiologic conditions, compared to the un-fused GH.

In another embodiment, the invention includes a method of increasing the shelf-life of a GH comprising the step of linking the GH with one or more XTEN selected such that the shelf-life of the resulting GHXTEN is extended compared to the GH in an un-fused state. As used herein, shelf-life refers to the period of time over which the functional activity of a GH or GHXTEN that is in solution or in some other storage formulation remains stable without undue loss of activity. As used herein, "functional activity" refers to a pharmacologic effect or biological activity, such as the ability to bind a receptor or ligand, or an enzymatic activity, or to display one or more known functional activities associated with a GH, as known in the art. A GH that degrades or aggregates generally has reduced functional activity or reduced bioavailability compared to one that remains in solution. Factors that contribute to the ability of the method to extend the shelf life of GHs when incorporated into a fusion protein include increased water solubility, reduced self-aggregation in solution, and increased heat stability of the XTEN fusion partner. In particular, the low tendency of XTEN to aggregate facilitates methods of formulating pharmaceutical preparations containing higher drug concentrations of GHs, and the heat-stability of XTEN contributes to the property of GHXTEN fusion proteins to remain soluble and functionally active for extended periods. In one embodiment, the method results in GHXTEN fusion proteins with "prolonged" or "extended" shelf-life that exhibit greater activity relative to a standard that has been subjected to the same storage and handling conditions. The standard may be the un-fused full-length GH. In one embodiment, the method includes the step of formulating the isolated GHXTEN with one or more pharmaceutically acceptable excipients that enhance the ability of the XTEN to retain its unstructured conformation and for the GHXTEN to remain soluble in the formulation for a time that is greater than that of the corresponding un-fused GH. In one embodiment, the method comprises linking a GH to one or more XTEN to create a GHXTEN fusion protein results in a solution that retains greater than about 100% of the functional activity, or greater than about 105%, 110%, 120%, 130%, 150% or 200% of the functional activity of a standard when compared at a given time point and when subjected to the same storage and handling conditions as the standard, thereby increasing its shelf-life.

Shelf-life may also be assessed in terms of functional activity remaining after storage, normalized to functional activity when storage began. GHXTEN fusion proteins of the invention with prolonged or extended shelf-life as exhibited by prolonged or extended functional activity retains about 50% more functional activity, or about 60%, 70%, 80%, or 90% more of the functional activity of the equivalent GH not linked to XTEN when subjected to the same conditions for the same period of time. For example, a GHXTEN fusion protein of the invention comprising human growth hormone fused to one or more XTEN sequences retains about 80% or more of its original activity in solution for periods of up to 2 weeks, or 4 weeks, or 6 weeks or longer under various temperature conditions. In some embodiments, the GHXTEN retains at least about 50%, or about 60%, or at least about 70%, or at least about 80%, and most preferably at least about 90% or more of its original activity in solution when heated at 80° C. for 10 min. In other embodiments, the GHXTEN retains at least about 50%, preferably at least about 60%, or at least about 70%, or at least about 80%, or alternatively at least about 90% or more of its original activity in solution when heated or maintained at 37° C. for about 7 days. In another embodiment, GHXTEN fusion protein retains at least about 80% or more of its functional activity after exposure to a temperature of about 30° C. to about 70° C. over a period of time of about one hour to about 18 hours. In the foregoing embodiments hereinabove described in this paragraph, the retained activity of the GHXTEN is at least about two-fold, or at least about three-fold, or at least about four-fold, or at least about five-fold, or at least about six-fold greater at a given time point than that of the corresponding GH not linked to the fusion protein.

VII). The Nucleic Acids Sequences of the Invention

The present invention provides isolated polynucleic acids encoding GHXTEN chimeric fusion proteins and sequences complementary to polynucleic acid molecules encoding GHXTEN chimeric fusion proteins, including homologous variants thereof. In another aspect, the invention encompasses methods to produce polynucleic acids encoding GHXTEN chimeric fusion proteins and sequences complementary to polynucleic acid molecules encoding GHXTEN chimeric fusion protein, including homologous variants thereof. In general, and as illustrated in FIGS. 4-6, the methods of producing a polynucleotide sequence coding for a GHXTEN fusion protein and expressing the resulting gene product include assembling nucleotides encoding GH and XTEN, ligating the components in frame, incorporating the encoding gene into an expression vector appropriate for a host cell, transforming the appropriate host cell with the expression vector, and culturing the host cell under conditions causing or permitting the fusion protein to be expressed in the transformed host cell, thereby producing the biologically-active GHXTEN polypeptide, which is recovered as an isolated fusion protein by standard protein purification methods known in the art. Standard recombinant techniques in molecular biology is used to make the polynucleotides and expression vectors of the present invention.

In accordance with the invention, nucleic acid sequences that encode GHXTEN (or its complement) is used to generate recombinant DNA molecules that direct the expression of GHXTEN fusion proteins in appropriate host cells. Several cloning strategies are suitable for performing the present invention, many of which is used to generate a construct that comprises a gene coding for a fusion protein of the GHXTEN composition of the present invention, or its complement. In some embodiments, the cloning strategy is used to create a gene that encodes a monomeric GHXTEN that comprises at least a first GH and at least a first XTEN polypeptide, or their complement. In one embodiment of the foregoing, the gene comprises a sequence encoding a hGH or sequence variant. In other embodiments, the cloning strategy is used to create a gene that encodes a monomeric GHXTEN that comprises nucleotides encoding at least a first molecule of GH or its complement and a first and at least a second XTEN or their complement that is used to transform a host cell for expression of the fusion protein of the GHXTEN composition. In the foregoing embodiments hereinabove described in this paragraph, the genes can further comprise nucleotides encoding spacer sequences that also encodes cleavage sequence(s).

In designing a desired XTEN sequences, it was discovered that the non-repetitive nature of the XTEN of the inventive compositions is achieved despite use of a "building block" molecular approach in the creation of the XTEN-encoding sequences. This was achieved by the use of a library of polynucleotides encoding peptide sequence motifs, described above, that are then ligated and/or multimerized to create the genes encoding the XTEN sequences (see FIGS. 4 and 5 and Examples). Thus, while the XTEN(s) of the expressed fusion protein may consist of multiple units of as few as four different sequence motifs, because the motifs themselves consist of non-repetitive amino acid sequences, the overall XTEN sequence is rendered non-repetitive. Accordingly, in one embodiment, the XTEN-encoding polynucleotides comprise multiple polynucleotides that encode non-repetitive sequences, or motifs, operably linked in frame and in which the resulting expressed XTEN amino acid sequences are non-repetitive.

In one approach, a construct is first prepared containing the DNA sequence corresponding to GHXTEN fusion protein. DNA encoding the GH of the compositions is obtained from a cDNA library prepared using standard methods from tissue or isolated cells believed to possess GH mRNA and to express it at a detectable level. Libraries is screened with probes containing, for example, about 20 to 100 bases designed to identify the GH gene of interest by hybridization using conventional molecular biology techniques. The best candidates for probes are those that represent sequences that are highly homologous for human growth hormone, and should be of sufficient length and sufficiently unambiguous that false positives are minimized, but may be degenerate at one or more positions. If necessary, the coding sequence can be obtained using conventional primer extension procedures as described in Sambrook, et al., supra, to detect precursors and processing intermediates of mRNA that may not have been reverse-transcribed into cDNA. One can then use polymerase chain reaction (PCR) methodology to amplify the target DNA or RNA coding sequence to obtain sufficient material for the preparation of the GHXTEN constructs containing the GH gene(s). Assays can then be conducted to confirm that hybridizing full-length genes are the desired GH gene(s). By these conventional methods, DNA can be conveniently obtained from a cDNA library prepared from such sources. The GH encoding gene(s) is also be obtained from a genomic library or created by standard synthetic procedures known in the art (e.g., automated nucleic acid synthesis using, for example one of the methods described in Engels et al. (Agnew. Chem. Int. Ed. Engl., 28:716-734 1989)), using DNA sequences obtained from publicly available databases, patents, or literature references. Such procedures are well known in the art and well described in the scientific and patent literature. For example, sequences can be obtained from Chemical Abstracts Services (CAS) Registry Numbers (published by the American Chemical Society) and/or GenBank Accession Numbers (e.g., Locus ID, NP_XXXXX, and XP_XXXXX) Model Protein identifiers available through the National Center for Biotechnology Information (NCBI) webpage, available on the world wide web at ncbi.nlm.nih.gov that correspond to entries in the CAS Registry or GenBank database that contain an amino acid sequence of the protein of interest or of a fragment or variant of the protein. For such sequence identifiers provided herein, the summary pages associated with each of these CAS and GenBank and GenSeq Accession Numbers as well as the cited journal publications (e.g., PubMed ID number (PMID)) are each incorporated by reference in their entireties, particularly with respect to the amino acid sequences described therein. In one embodiment, the GH encoding gene encodes a protein from any one of Table 1, or a fragment or variant thereof.

A gene or polynucleotide encoding the GH portion of the subject GHXTEN protein, in the case of an expressed fusion protein that comprises a single GH is then be cloned into a construct, which is a plasmid or other vector under control of appropriate transcription and translation sequences for high level protein expression in a biological system. In a later step, a second gene or polynucleotide coding for the XTEN is genetically fused to the nucleotides encoding the N- and/or C-terminus of the GH gene by cloning it into the construct adjacent and in frame with the gene(s) coding for the GH. This second step occurs through a ligation or multimerization step. In the foregoing embodiments hereinabove described in this paragraph, it is to be understood that the gene constructs that are created can alternatively be the complement of the respective genes that encode the respective fusion proteins.

The gene encoding for the XTEN can be made in one or more steps, either fully synthetically or by synthesis combined with enzymatic processes, such as restriction enzyme-mediated cloning, PCR and overlap extension, including methods more fully described in the Examples. The methods disclosed herein can be used, for example, to ligate short sequences of polynucleotides encoding XTEN into longer XTEN genes of a desired length and sequence. In one embodiment, the method ligates two or more codon-optimized oligonucleotides encoding XTEN motif or segment sequences of about 9 to 14 amino acids, or about 12 to 20 amino acids, or about 18 to 36 amino acids, or about 48 to about 144 amino acids, or about 144 to about 288 or longer, or any combination of the foregoing ranges of motif or segment lengths.

Alternatively, the disclosed method is used to multimerize XTEN-encoding sequences into longer sequences of a desired length; e.g., a gene encoding 36 amino acids of XTEN can be dimerized into a gene encoding 72 amino acids, then 144, then 288, etc. Even with multimerization, XTEN polypeptides can be constructed such that the XTEN-encoding gene has low or virtually no repetitiveness through design of the codons selected for the motifs of the shortest unit used, which can reduce recombination and increase stability of the encoding gene in the transformed host. Genes encoding XTEN with non-repetitive sequences is assembled from oligonucleotides using standard techniques of gene synthesis. The gene design can be performed using algorithms that optimize codon usage and amino acid composition. In one method of the invention, a library of relatively short XTEN-encoding polynucleotide constructs is created and then assembled, as illustrated in FIGS. 4 and 5. This can be a pure codon library such that each library member has the same amino acid sequence but many different coding sequences are possible. Such libraries can be assembled from partially randomized oligonucleotides and used to generate large libraries of XTEN segments comprising the sequence motifs. The randomization scheme can be optimized to control amino acid choices for each position as well as codon usage. Exemplary methods to achieve the foregoing are disclosed in the Examples.

Polynucleotide Libraries

In another aspect, the invention provides libraries of polynucleotides that encode XTEN sequences that is used to assemble genes that encode XTEN of a desired length and sequence.

In certain embodiments, the XTEN-encoding library constructs comprise polynucleotides that encode polypeptide segments of a fixed length. As an initial step, a library of oligonucleotides that encode motifs of 9-14 amino acid residues can be assembled. In a preferred embodiment, libraries of oligonucleotides that encode motifs of 12 amino acids are assembled.

The XTEN-encoding sequence segments can be dimerized or multimerized into longer encoding sequences. Dimerization or multimerization can be performed by ligation, overlap extension, PCR assembly or similar cloning techniques known in the art. This process of can be repeated multiple times until the resulting XTEN-encoding sequences have reached the organization of sequence and desired length, providing the XTEN-encoding genes. As will be appreciated, a library of polynucleotides that encodes, e.g., 12 amino acid motifs can be dimerized and/or ligated into a library of polynucleotides that encode 36 amino acids. Libraries encoding motifs of different lengths; e.g., 9-14 amino acid motifs leading to libraries encoding 27 to 42 amino acids are contemplated by the invention. In turn, the library of polynucleotides that encode 27 to 42 amino acids, and preferably 36 amino acids (as described in the Examples) can be serially dimerized into a library containing successively longer lengths of polynucleotides that encode XTEN sequences of a desired length for incorporation into the gene encoding the GHXTEN fusion protein, as disclosed herein. In some embodiments, libraries are assembled of polynucleotides that encode amino acids that are limited to specific sequence XTEN families; e.g., AD, AE, AF, AG, AM, or AQ sequences of Table 2. In other embodiments, libraries comprise sequences that encode two or more of the motif family sequences from Table 2. The names and sequences of representative, non-limiting polynucleotide sequences of libraries that encode 36mers are presented in Tables 8-11, and the methods used to create them are described more fully in the Examples. In other embodiments, libraries that encode XTEN are constructed from segments of polynucleotide codons linked in a randomized sequence that encode amino acids wherein at least about 80%, or at least about 90%, or at least about 91%, or at least about 92%, or at least about 93%, or at least about 94%, or at least about 95%, or at least about 97%, or at least about 98%, or at least about 99% of the codons are selected from the group consisting of condons for glycine (G), alanine (A), serine (S), threonine (T), glutamate (E) and proline (P) amino acids. The libraries can be used, in turn, for serial dimerization or ligation to achieve polynucleotide sequence libraries that encode XTEN sequences, for example, of 48, 72, 144, 288, 576, 864, 875, 912, 923, 1318 amino acids, or up to a total length of about 3000 amino acids, as well as intermediate lengths, in which the encoded XTEN can have one or more of the properties disclosed herein, when expressed as a component of a GHXTEN fusion protein. In some cases, the polynucleotide library sequences may also include additional bases used as "sequencing islands," described more fully below.

FIG. 5 is a schematic flowchart of representative, non-limiting steps in the assembly of a XTEN polynucleotide construct and a GHXTEN polynucleotide construct in the embodiments of the invention. Individual oligonucleotides 501 are annealed into sequence motifs 502 such as a 12 amino acid motif ("12-mer"), which is subsequently ligated with an oligo containing BbsI, and KpnI restriction sites 503. Additional sequence motifs from a library are annealed to the 12-mer until the desired length of the XTEN gene 504 is achieved. The XTEN gene is cloned into a stuffer vector. The vector optionally encodes a Flag sequence 506 followed by a stuffer sequence that is flanked by BsaI, BbsI, and KpnI sites 507 and, in this case, a single GH gene (encoding hGH in this example) 508, resulting in the gene encoding a GHXTEN comprising a single GH 500. A non-exhaustive list of the XTEN names for polynucleotides encoding XTEN and precursor sequences is provided in Table 7.

TABLE 7

DNA sequences of XTEN and precursor sequences

| XTEN Name | SEQ ID NO: | DNA Nucleotide Sequence |
|---|---|---|
| AE48 | 107 | ATGGCTGAACCTGCTGGCTCTCCAACCTCCACTGAGGAAGGTACCCCGGGTAGCGGTA CTGCTTCTTCCTCTCCAGGTAGCTCTACCCCTTCTGGTGCAACCGGCTCTCCAGGTGCT TCTCCGGGCACCAGCTCTACCGGTTCT |
| AM48 | 108 | ATGGCTGAACCTGCTGGCTCTCCAACCTCCACTGAGGAAGGTGCATCCCCGGGCACCA GCTCTACCGGTTCTCCAGGTAGCTCTACCCCGTCTGGTGCTACCGGCTCTCCAGGTAGC TCTACCCCGTCTGGTGCTACTGGCTCT |
| AE144 | 109 | GGTAGCGAACCGGCAACTTCCGGCTCTGAAACCCCAGGTACTTCTGAAAGCGCTACTC CTGAGTCTGGCCCAGGTAGCGAACCTGCTACCTCTGGCTCTGAAACCCCAGGTAGCCC GGCAGGCTCTCCGACTTCCACCGAGGAAGGTACCTCTACTGAACCTTCTGAGGGTAGC GCTCCAGGTAGCGAACCGGCAACCTCTGGCTCTGAAACCCCAGGTAGCGAACCTGCTA CCTCCGGCTCTGAAACTCCAGGTAGCGAACCGGCTACTTCCGGTTCTGAAACTCCAGG TACCTCTACCGAACCTTCCGAAGGCAGCGCACCAGGTACTTCTGAAAGCGCAACCCCT GAATCCGGTCCAGGTAGCGAACCGGCTACTTCTGGCTCTGAGACTCCAGGTACTTCTA CCGAACCGTCCGAAGGTAGCGCACCA |
| AF144 | 110 | GGTACTTCTACTCCGGAAAGCGGTTCCGCATCTCCAGGTACTTCTCCTAGCGGTGAATC TTCTACTGCTCCAGGTACCTCTCCTAGCGGCGAATCTTCTACTGCTCCAGGTTCTACCA GCTCTACCGCTGAATCTCCTGGCCCAGGTTCTACCAGCGAATCCCCGTCTGGCACCGC ACCAGGTTCTACTAGCTCTACCGCAGAATCTCCGGGTCCAGGTACTTCCCCTAGCGGT GAATCTTCTACTGCTCCAGGTACCTCTACTCCGGAAAGCGGCTCCGCATCTCCAGGTTC TACTAGCTCTACTGCTGAATCTCCTGGTCCAGGTACCTCCCCTAGCGGCGAATCTTCTA |

TABLE 7-continued

DNA sequences of XTEN and precursor sequences

| XTEN Name | SEQ ID NO: | DNA Nucleotide Sequence |
|---|---|---|
| | | CTGCTCCAGGTACCTCTCCTAGCGGCGAATCTTCTACCGCTCCAGGTACCTCCCCTAGC<br>GGTGAATCTTCTACCGCACCA |
| AE288 | 111 | GGTACCTCTGAAAGCGCAACTCCTGAGTCTGGCCCAGGTAGCGAACCTGCTACCTCCG<br>GCTCTGAGACTCCAGGTACCTCTGAAAGCGCAACCCCGGAATCTGGTCCAGGTAGCGA<br>ACCTGCAACCTCTGGCTCTGAAACCCCAGGTACCTCTGAAAGCGCTACTCCTGAATCT<br>GGCCCAGGTACTTCTACTGAACCGTCCGAGGGCAGCGCACCAGGTAGCCCTGCTGGCT<br>CTCCAACCTCCACCGAAGAAGGTACCTCTGAAAGCGCAACCCCTGAATCCGGCCCAGG<br>TAGCGAACCGGCAACCTCCGGTTCTGAAACCCCAGGTACTTCTGAAAGCGCTACTCCT<br>GAGTCCGGCCCAGGTAGCCCGGCTGGCTCTCCGACTTCCACCGAGGAAGGTAGCCCGG<br>CTGGCTCTCCAACTTCTACTGAAGAAGGTACTTCTACCGAACCTTCCGAGGGCAGCGC<br>ACCAGGTACTTCTGAAAGCGCTACCCCTGAGTCCGGCCCAGGTACTTCTGAAAGCGCT<br>ACTCCTGAATCCGGTCCAGGTACTTCTGAAAGCGCTACCCCGGAATCTGGCCCAGGTA<br>GCGAACCGGCTACTTCTGGTTCTGAAACCCCAGGTAGCGAACCGGCTACCTCCGGTTC<br>TGAAACTCCAGGTAGCCCAGCAGGCTCTCCGACTTCCACTGAGGAAGGTACTTCTACT<br>GAACCTTCCGAAGGCAGCGCACCAGGTACTTCTACTGAACCTTCTGAGGGCAGCGCTC<br>CAGGTAGCGAACCTGCAACCTCTGGCTCTGAAACCCCAGGTACCTCTGAAAGCGCTAC<br>TCCTGAATCTGGCCCAGGTACTTCTACTGAACCGTCCGAGGGCAGCGCACCA |
| AE576 | 112 | GGTAGCCCGGCTGGCTCTCCTACCTCTACTGAGGAAGGTACTTCTGAAAGCGCTACTC<br>CTGAGTCTGGTCCAGGTACCTCTACTGAACCGTCCGAAGGTAGCGCTCCAGGTAGCCC<br>AGCAGGCTCTCCGACTTCCACTGAGGAAGGTACTTCTACTGAACCTTCCGAAGGCAGC<br>GCACCAGGTACCTCTACTGAACCTTCTGAGGGCAGCGCTCCAGGTACTTCTGAAAGCG<br>CTACCCCGGAATCTGGCCCAGGTAGCGAACCGGCTACTTCTGGTTCTGAAACCCCAGG<br>TAGCGAACCGGCTACCTCCGGTTCTGAAACTCCAGGTAGCCCGGCAGGCTCTCCGACC<br>TCTACTGAGGAAGGTACTTCTGAAAGCGCAACCCCGGAGTCCGGCCCAGGTACCTCTA<br>CCGAACCGTCTGAGGGCAGCGCACCAGGTACTTCTACCGAACCGTCCGAGGGTAGCG<br>CACCAGGTAGCCCAGCAGGTTCTCCTACCTCCACCGAGGAAGGTACTTCTACCGAACC<br>GTCCGAGGGTAGCGCACCAGGTACCTCTACTGAACCTTCTGAGGGCAGCGCTCCAGGT<br>ACTTCTGAAAGCGCTACCCCGGAGTCCGGTCCAGGTACTTCTACTGAACCGTCCGAAG<br>GTAGCGCACCAGGTACTTCTGAAAGCGCAACCCCTGAATCCGGTCCAGGTAGCGAACC<br>GGCTACTTCTGGCTCTGAGACTCCAGGTACTTCTACCGAACCGTCCGAAGGTAGCGCA<br>CCAGGTACTTCTACTGAACCGTCTGAAGGTAGCGCACCAGGTACTTCTGAAAGCGCAA<br>CCCCGGAATCCGGCCCAGGTACCTCTGAAAGCGCAACCCCGGAGTCCGGCCCAGGTA<br>GCCCTGCTGGCTCTCCAACCTCCACCGAAGAAGGTACCTCTGAAAGCGCAACCCCTGA<br>ATCCGGCCCAGGTAGCGAACCGGCAACCTCCGGTTCTGAAACCCCAGGTACCTCTGAA<br>AGCGCTACTCCGGAGTCTGGCCCAGGTACCTCTACTGAACCGTCTGAGGGTAGCGCTC<br>CAGGTACTTCTACTGAACCGTCCGAAGGTAGCGCACCAGGTACTTCTACCGAACCGTC<br>CGAAGGCAGCGCTCCAGGTACCTCTACTGAACCTTCCGAGGGCAGCGCTCCAGGTACC<br>TCTACCGAACCTTCTGAAGGTAGCGCACCAGGTACTTCTACCGAACCGTCCGAGGGTA<br>GCGCACCAGGTAGCCCAGCAGGTTCTCCTACCTCCACCGAGGAAGGTACTTCTACCGA<br>ACCGTCCGAGGGTAGCGCACCAGGTACCTCTGAAAGCGCAACTCCTGAGTCTGGCCCA<br>GGTAGCGAACCTGCTACCTCCGGCTCTGAGACTCCAGGTACCTCTGAAAGCGCAACCC<br>CGGAATCTGGTCCAGGTAGCGAACCTGCAACCTCTGGCTCTGAAACCCCAGGTACCTC<br>TGAAAGCGCTACTCCTGAATCTGGCCCAGGTACTTCTACTGAACCGTCCGAGGGCAGC<br>GCACCAGGTACTTCTGAAAGCGCTACTCCTGAGTCCGGCCCAGGTAGCCCGGCTGGCT<br>CTCCGACTTCCACCGAGGAAGGTAGCCCGGCTGGCTCTCCAACTTCTACTGAAGAAGG<br>TAGCCCGGCAGGCTCTCCGACCTCTACTGAGGAAGGTACTTCTGAAAGCGCAACCCCG<br>GAGTCCGGCCCAGGTACCTCTACCGAACCGTCTGAGGGCAGCGCACCA |
| AF576 | 113 | GGTTCTACTAGCTCTACCGCTGAATCTCCTGGCCCAGGTTCCACTAGCTCTACCGCAGA<br>ATCTCCGGGCCCAGGTTCTACTAGCGAATCCCCTTCTGGTACCGCTCCAGGTTCTACTA<br>GCTCTACCGCTGAATCTCCGGTCTCAGGTTCTACCAGCTCTACTGCAGAATCTCCTGGC<br>CCAGGTACTTCTACTCCGGAAAGCGGTTCCGCTTCTCCAGGTTCTACCAGCGAATCTCC<br>TTCTGGCACCGCTCCAGGTACCTCTCCTAGCGGCGAATCTTCTACCGCTCCAGGTTCTA<br>CTAGCGAATCTCCTTCTGGCACTGCACCAGGTTCTACCAGCGAATCTCCTTCTGGCACC<br>GCTCCAGGTACCTCTCCTAGCGGCGAATCTTCTACCGCTCCAGGTTCTACTAGCGAATC<br>TCCTTCTGGCACTGCACCAGGTTCTACCAGCGAATCTCCTTCTGGCACCGCTCCAGGTA<br>CCTCTCCTAGCGGCGAATCTTCTACCGCTCCAGGTTCTACTAGCGAATCTCCTTCTGGC<br>ACTGCACCAGGTTCTACTAGCGAATCTCCTTCTGGCACTGCACCAGGTTCTACCAGCG<br>AATCTCCGTCTGGCACTGCACCAGGTACCTCTACCCCTGAAAGCGGTTCCGCTTCTCCA<br>GGTTCTACTAGCGAATCTCCTTCTGGTACCGCTCCAGGTACTTCTACCCCTGAAAGCGG<br>CTCCGCTTCTCCAGGTTCCACTAGCTCTACCGCTGAATCTCCGGGTCCAGGTTCTACTA<br>GCTCTACTGCAGAATCTCCTGGCCCAGGTACCTCTACTCCGGAAAGCGGCTCTGCATC<br>TCCAGGTACTTCTACCCCTGAAAGCGGTTCTGCATCTCCAGGTTCTACTAGCGAATCCC<br>GTCTGGTACCGCACCAGGTACTTCTACCCCGGAAAGCGGCTCTGCTTCTCCAGGTAC<br>TTCTACCCCGGAAAGCGGCTCCGCATCTCCAGGTTCTACTAGCGAATCTCCTTCTGGTA<br>CCGCTCCAGGTTCTACCAGCGAATCCCGTCTGGTACTGCTCCAGGTTCTACCAGCGA<br>ATCTCCTTCTGGTACTGCACCAGGTTCTACTAGCTCTACTGCAGAATCTCCTGGCCCAG<br>GTACCTCTACTCCGGAAAGCGGCTCTGCATCTCCAGGTACTTCTACCCCTGAAAGCGG<br>TTCTGCATCTCCAGGTTCTACTAGCGAATCTCCTTCTGGCACTGCACCAGGTTCTACCA<br>GCGAATCTCCGTCTGGCACTGCACCAGGTACCTCTACCCCTGAAAGCGGTTCCGCTTCT<br>CCAGGTTCTACTAGCGAATCTCCTTCTGGCACTGCACCAGGTTCTACCAGCGAATCTCC<br>GTCTGGCACTGCACCAGGTACCTCTACCCCTGAAAGCGGTTCCGCTTCTCCAGGTACTT<br>CTCCGAGCGGTGAATCTTCTACCGCACCAGGTTCTACTAGCTCTACCGCTGAATCTCCG |

TABLE 7-continued

DNA sequences of XTEN and precursor sequences

| XTEN Name | SEQ ID NO: | DNA Nucleotide Sequence |
|---|---|---|
| | | GGCCCAGGTACTTCTCCGAGCGGTGAATCTTCTACTGCTCCAGGTTCCACTAGCTCTAC<br>TGCTGAATCTCCTGGCCCAGGTACTTCTACTCCGGAAAGCGGTTCCGCTTCTCCAGGTT<br>CTACTAGCGAATCTCCGTCTGGCACCGCACCAGGTTCTACTAGCTCTACTGCAGAATCT<br>CCTGGCCCAGGTACCTCTACTCCGGAAAGCGGCTCTGCATCTCCAGGTACTTCTACCCC<br>TGAAAGCGGTTCTGCATCTCCA |
| AE624 | 114 | ATGGCTGAACCTGCTGGCTCTCCAACCTCCACTGAGGAAGGTACCCCGGGTAGCGGTA<br>CTGCTTCTTCCTCTCCAGGTAGCTCTACCCCTTCTGGTGCAACCGGCTCTCCAGGTGCT<br>CTCCGGGCACCAGCTCTACCGGTTCTCCAGGTAGCCCGGCTGGCTCTCCTACCTCTAC<br>TGAGGAAGGTACTTCTGAAAGCGCTACTCCTGAGTCTGGTCCAGGTACCTCTACTGAA<br>CCGTCCGAAGGTAGCGCTCCAGGTAGCCCAGCAGGCTCTCCGACTTCCACTGAGGAAG<br>GTACTTCTACTGAACCTTCCGAAGGCAGCGCACCAGGTACCTCTACTGAACCTTCTGA<br>GGGCAGCGCTCCAGGTACTTCTGAAAGCGCTACCCCGGAATCTGGCCCAGGTAGCGA<br>ACCGGCTACTTCTGGTTCTGAAACCCCAGGTAGCGAACCGGCTACCTCCGGTTCTGAA<br>ACTCCAGGTAGCCCGGCAGGCTCTCCGACCTCTACTGAGGAAGGTACTTCTGAAAGCG<br>CAACCCCGGAGTCCGGCCCAGGTACCTCTACCGAACCGTCTGAGGGCAGCGCACCAG<br>GTACTTCTACCGAACCGTCCGAGGGTAGCGCACCAGGTAGCCCAGCAGGTTCTCCTAC<br>CTCCACCGAGGAAGGTACTTCTACCGAACCGTCCGAGGGTAGCGCACCAGGTACCTCT<br>ACTGAACCTTCTGAGGGCAGCGCTCCAGGTACTTCTGAAAGCGCTACCCCGGAGTCCG<br>GTCCAGGTACTTCTACTGAACCGTCCGAAGGTAGCGCACCAGGTACTTCTGAAAGCGC<br>AACCCCTGAATCCGGTCCAGGTAGCGAACCGGCTACTTCTGGCTCTGAGACTCCAGGT<br>ACTTCTACCGAACCGTCCGAAGGTAGCGCACCAGGTACTTCTACTGAACCGTCTGAAG<br>GTAGCGCACCAGGTACTTCTGAAAGCGCAACCCCGGAATCCGGCCCAGGTACCTCTGA<br>AAGCGCAACCCCGGAGTCCGGCCCAGGTAGCCCTGCTGGCTCTCCAACCTCCACCGAA<br>GAAGGTACCTCTGAAAGCGCAACCCCTGAATCCGGCCCAGGTAGCGAACCGGCAACC<br>TCCGGTTCTGAAACCCCAGGTACCTCTGAAAGCGCTACTCCGGAGTCTGGCCCAGGTA<br>CCTCTACTGAACCGTCTGAGGGTAGCGCTCCAGGTACTTCTACTGAACCGTCCGAAGG<br>TAGCGCACCAGGTACTTCTACCGAACCGTCCGAAGGCAGCGCTCCAGGTACCTCTACT<br>GAACCTTCCGAGGGCAGCGCTCCAGGTACCTCTACCGAACCTTCTGAAGGTAGCGCAC<br>CAGGTACTTCTACCGAACCGTCCGAGGGTAGCGCACCAGGTAGCCCAGCAGGTTCTCC<br>TACCTCCACCGAGGAAGGTACTTCTACCGAACCGTCCGAGGGTAGCGCACCAGGTACC<br>TCTGAAAGCGCAACTCCTGAGTCTGGCCCAGGTAGCGAACCTGCTACCTCCGGCTCTG<br>AGACTCCAGGTACCTCTGAAAGCGCAACCCCGGAATCTGGTCCAGGTAGCGAACCTGC<br>AACCTCTGGCTCTGAAACCCCAGGTACCTCTGAAAGCGCTACTCCTGAATCTGGCCCA<br>GGTACTTCTACTGAACCGTCCGAGGGCAGCGCACCAGGTACTTCTGAAAGCGCTACTC<br>CTGAGTCCGGCCCAGGTAGCCCGGCTGGCTCTCCGACTTCCACCGAGGAAGGTAGCCC<br>GGCTGGCTCTCCAACTTCTACTGAAGAAGGTAGCCCGGCAGGCTCTCCGACCTCTACT<br>GAGGAAGGTACTTCTGAAAGCGCAACCCCGGAGTCCGGCCCAGGTACCTCTACCGAA<br>CCGTCTGAGGGCAGCGCACCA |
| AM875 | 115 | GGTACTTCTACTGAACCGTCTGAAGGCAGCGCACCAGGTAGCGAACCGGCTACTTCCG<br>GTTCTGAAACCCCAGGTAGCCCAGCAGGTTCTCCAACTTCTACTGAAGAAGGTTCTAC<br>CAGCTCTACCGCAGAATCTCCTGGTCCAGGTACCTCTACTCCGGAAAGCGGCTCTGCA<br>TCTCCAGGTTCTACTAGCGAATCTCCTTCTGGCACTGCACCAGGTTCTACTAGCGAATC<br>CCCGTCTGGTACTGCTCCAGGTACTTCTACTCCTGAAAGCGGTTCCGCTTCTCCAGGTA<br>CCTCTACTCCGGAAAGCGGTTCTGCATCTCCAGGTAGCGAACCGGCAACCTCCGGCTC<br>TGAAACCCCAGGTACCTCTGAAAGCGCTACTCCTGAATCCGGCCCAGGTAGCCCGGCA<br>GGTTCTCCGACTTCCACTGAGGAAGGTACCTCTACTGAACCTTCTGAGGGCAGCGCTC<br>CAGGTACTTCTGAAAGCGCTACCCCGGAGTCCGGTCCAGGTACTTCTACTGAACCGTC<br>CGAAGGTAGCGCACCAGGTACTTCTACCGAACCGTCCGAGGGTAGCGCACCAGGTAG<br>CCCAGCAGGTTCTCCTACCTCCACCGAGGAAGGTACTTCTACCGAACCGTCCGAGGGT<br>AGCGCACCAGGTACTTCTACCGAACCTTCCGAGGGCAGCGCACCAGGTACTTCTGAAA<br>GCGCTACCCCTGAGTCCGGCCCAGGTACTTCTGAAAGCGCTACTCCTGAATCCGGTCC<br>AGGTACCTCTACTGAACCTTCCGAAGGCAGCGCTCCAGGTACCTCTACCGAACCGTCC<br>GAGGGCAGCGCACCAGGTACTTCTGAAAGCGCAACCCCTGAATCCGGTCCAGGTACTT<br>CTACTGAACCTTCCGAAGGTAGCGCTCCAGGTAGCGAACCTGCTACTTCTGGTTCTGA<br>AACCCCAGGTAGCCCGGCTGGCTCTCCGACCTCCACCGAGGAAGGTAGCTCTACCCCG<br>TCTGGTGCTACTGGTTCTCCAGGTACTCCGGGCAGCGGTACTGCTTCTTCCTCTCCAGG<br>TAGCTCTACCCCTTCTGGTGCTACTGGCTCTCCAGGTACCTCTACCGAACCGTCCGAGG<br>GTAGCGCACCAGGTACCTCTACTGAACCGTCTGAGGGTAGCGCTCCAGGTAGCGAACC<br>GGCAACCTCCGGTTCTGAAACTCCAGGTAGCCCTGCTGGCTCTCCGACTTCTACTGAG<br>GAAGGTAGCCCGGCTGGTTCTCCGACTTCTACTGAGGAAGGTACTTCTACCGAACCTT<br>CCGAAGGTAGCGCTCCAGGTGCAAGCGCAAGCGGCGCGCAAGCACGGGAGGTACTT<br>CTGAAAGCGCTACTCCTGAGTCCGGCCCAGGTAGCCCGGCTGGCTCTCCGACTTCCAC<br>CGAGGAAGGTAGCCCGGCTGGCTCTCCAACTTCTACTGAAGAAGGTTCTACCAGCTCT<br>ACCGCTGAATCTCCTGGCCCAGGTTCTACTAGCGAATCTCCGTCTGGCACCGCACCAG<br>GTACTTCCCCTAGCGGTGAATCTTCTACTGCACCAGGTACCCCTGGCAGCGGTACCGC<br>TTCTTCCTCTCCAGGTAGCTCTACCCCGTCTGGTGCTACTGGCTCTCCAGGTTCTAGCC<br>CGTCTGCATCTACCGGTACCGGCCCAGGTAGCGAACCGGCAACCTCCGGCTCTGAAAC<br>TCCAGGTACTTCTGAAAGCGCTACTCCGGAATCCGGCCCAGGTAGCGAACCGGCTACT<br>TCCGGCTCTGAAACCCCAGGTTCCACCAGCTCTACTGCAGAATCTCCGGGCCCAGGTT<br>CTACTAGCTCTACTGCAGAATCTCCGGGTCCAGGTACTTCTCCTAGCGGCGAATCTTCT<br>ACCGCTCCAGGTAGCGAACCGGCAACCTCTGGCTCTGAAACTCCAGGTAGCGAACCTG<br>CAACCTCCGGCTCTGAAACCCCAGGTACTTCTACTGAACCTTCTGAGGGCAGCGCACC<br>AGGTTCTACCAGCTCTACCGCAGAATCTCCTGGTCCAGGTACCTCTACTCCGGAAAGC |

TABLE 7-continued

DNA sequences of XTEN and precursor sequences

| XTEN Name | SEQ ID NO: | DNA Nucleotide Sequence |
|---|---|---|
| | | GGCTCTGCATCTCCAGGTTCTACTAGCGAATCTCCTTCTGGCACTGCACCAGGTACTTC<br>TACCGAACCGTCCGAAGGCAGCGCTCCAGGTACCTCTACTGAACCTTCCGAGGGCAGC<br>GCTCCAGGTACCTCTACCGAACCTTCTGAAGGTAGCGCACCAGGTAGCTCTACTCCGT<br>CTGGTGCAACCGGCTCCCCAGGTTCTAGCCCGTCTGCTTCCACTGGTACTGGCCCAGGT<br>GCTTCCCCGGGCACCAGCTCTACTGGTTCTCCAGGTAGCGAACCTGCTACCTCCGGTTC<br>TGAAACCCCAGGTACCTCTGAAAGCGCAACTCCGGAGTCTGGTCCAGGTAGCCCTGCA<br>GGTTCTCCTACCTCCACTGAGGAAGGTAGCTCTACTCCGTCTGGTGCAACCGGCTCCCC<br>AGGTTCTAGCCCGTCTGCTTCCACTGGTACTGGCCCAGGTGCTTCCCCGGGCACCAGCT<br>CTACTGGTTCTCCAGGTACCTCTGAAAGCGCTACTCCGGAGTCTGGCCCAGGTACCTCT<br>ACTGAACCGTCTGAGGGTAGCGCTCCAGGTACTTCTACTGAACCGTCCGAAGGTAGCG<br>CACCA |
| AE864 | 116 | GGTAGCCCGGCTGGCTCTCCTACCTCTACTGAGGAAGGTACTTCTGAAAGCGCTACTC<br>CTGAGTCTGGTCCAGGTACCTCTACTGAACCGTCCGAAGGTAGCGCTCCAGGTAGCCC<br>AGCAGGCTCTCCGACTTCCACTGAGGAAGGTACTTCTACTGAACCTTCCGAAGGCAGC<br>GCACCAGGTACCTCTACTGAACCTTCTGAGGGCAGCGCTCCAGGTACTTCTGAAAGCG<br>CTACCCCGGAATCTGGCCCAGGTAGCGAACCGGCTACTTCTGGTTCTGAAACCCCAGG<br>TAGCGAACCGGCTACCTCCGGTTCTGAAACTCCAGGTAGCCCGGCAGGCTCTCCGACC<br>TCTACTGAGGAAGGTACTTCTGAAAGCGCAACCCCGGAGTCCGGCCCAGGTACCTCTA<br>CCGAACCGTCTGAGGGCAGCGCACCAGGTACTTCTACCGAACCGTCCGAGGGTAGCG<br>CACCAGGTAGCCCAGCAGGTTCTCCTACCTCCACCGAGGAAGGTACTTCTACCGAACC<br>GTCCGAGGGTAGCGCACCAGGTACCTCTACTGAACCTTCTGAGGGCAGCGCTCCAGGT<br>ACTTCTGAAAGCGCTACCCCGGAGTCCGGTCCAGGTACTTCTACTGAACCGTCCGAAG<br>GTAGCGCACCAGGTACTTCTGAAAGCGCAACCCCTGAATCCGGTCCAGGTAGCGAACC<br>GGCTACTTCTGGCTCTGAGACTCCAGGTACTTCTACCGAACCGTCCGAAGGTAGCGCA<br>CCAGGTACTTCTACTGAACCGTCTGAAGGTAGCGCACCAGGTACTTCTGAAAGCGCAA<br>CCCCGGAATCCGGCCCAGGTACCTCTGAAAGCGCAACCCCGGAGTCCGGCCCAGGTA<br>GCCCTGCTGGCTCTCCAACCTCCACCGAAGAAGGTACCTCTGAAAGCGCAACCCCTGA<br>ATCCGGCCCAGGTAGCGAACCGGCAACCTCCGGTTCTGAAACCCCAGGTACCTCTGAA<br>AGCGCTACTCCGGAGTCTGGCCCAGGTACCTCTACTGAACCGTCTGAGGGTAGCGCTC<br>CAGGTACTTCTACTGAACCGTCCGAAGGTAGCGCACCAGGTACTTCTACCGAACCGTC<br>CGAAGGCAGCGCTCCAGGTACCTCTACTGAACCTTCCGAGGGCAGCGCTCCAGGTACC<br>TCTACCGAACCTTCTGAAGGTAGCGCACCAGGTACTTCTACCGAACCGTCCGAGGGTA<br>GCGCACCAGGTAGCCCAGCAGGTTCTCCTACCTCCACCGAGGAAGGTACTTCTACCGA<br>ACCGTCCGAGGGTAGCGCACCAGGTACCTCTGAAAGCGCAACTCCTGAGTCTGGCCCA<br>GGTAGCGAACCTGCTACCTCCGGCTCTGAGACTCCAGGTACCTCTGAAAGCGCAACCC<br>CGGAATCTGGTCCAGGTAGCGAACCTGCAACCTCTGGCTCTGAAACCCCAGGTACCTC<br>TGAAAGCGCTACTCCTGAATCTGGCCCAGGTACTTCTACTGAACCGTCCGAGGGCAGC<br>GCACCAGGTACTTCTGAAAGCGCTACTCCTGAGTCCGGCCCAGGTAGCCCGGCTGGCT<br>CTCCGACTTCCACCGAGGAAGGTAGCCCGGCTGGCTCTCCAACTTCTACTGAAGAAGG<br>TAGCCCGGCAGGCTCTCCGACCTCTACTGAGGAAGGTACTTCTGAAAGCGCAACCCCG<br>GAGTCCGGCCCAGGTACCTCTACCGAACCGTCTGAGGGCAGCGCACCAGGTACCTCTG<br>AAAGCGCAACTCCTGAGTCTGGCCCAGGTAGCGAACCTGCTACCTCCGGCTCTGAGAC<br>TCCAGGTACCTCTGAAAGCGCAACCCCGGAATCTGGTCCAGGTAGCGAACCTGCAACC<br>TCTGGCTCTGAAACCCCAGGTACCTCTGAAAGCGCTACTCCTGAATCTGGCCCAGGTA<br>CTTCTACTGAACCGTCCGAGGGCAGCGCACCAGGTAGCCCTGCTGGCTCTCCAACCTC<br>CACCGAAGAAGGTACCTCTGAAAGCGCAACCCCTGAATCCGGCCCAGGTAGCGAACC<br>GGCAACCTCCGGTTCTGAAACCCCAGGTACTTCTGAAAGCGCTACTCCTGAGTCCGGC<br>CCAGGTAGCCCGGCTGGCTCTCCGACTTCCACCGAGGAAGGTAGCCCGGCTGGCTCTC<br>CAACTTCTACTGAAGAAGGTACTTCTACCGAACCTTCCGAGGGCAGCGCACCAGGTAC<br>TTCTGAAAGCGCTACCCCTGAGTCCGGCCCAGGTACTTCTGAAAGCGCTACTCCTGAA<br>TCCGGTCCAGGTACTTCTGAAAGCGCTACCCCGGAATCTGGCCCAGGTAGCGAACCGG<br>CTACTTCTGGTTCTGAAACCCCAGGTAGCGAACCGGCTACCTCCGGTTCTGAAACTCC<br>AGGTAGCCCAGCAGGCTCTCCGACTTCCACTGAGGAAGGTACTTCTACTGAACCTTCC<br>GAAGGCAGCGCACCAGGTACCTCTACTGAACCTTCTGAGGGCAGCGCTCCAGGTAGC<br>GAACCTGCAACCTCGGCTCTGAAACCCCAGGTACCTCTGAAAGCGCTACTCCTGAAT<br>CTGGCCCAGGTACTTCTACTGAACCGTCCGAGGGCAGCGCACCA |
| AF864 | 117 | GGTTCTACCAGCGAATCTCCTTCTGGCACCGCTCCAGGTACCTCTCCTAGCGGCGAATC<br>TTCTACCGCTCCAGGTTCTACTAGCGAATCTCCTTCTGGCACTGCACCAGGTTACTACTA<br>GCGAATCCCCGTCTGGTACTGCTCCAGGTACTTCTACTCCTGAAAGCGGTTCCGCTTCT<br>CCAGGTACCTCTACTCCGGAAAGCGGTTCTGCATCTCCAGGTTCTACCAGCGAATCTC<br>CTTCTGGCACCGCTCCAGGTTCTACTAGCGAATCCCGTCTGGTACCGCACCAGGTACT<br>TCTCCTAGCGGCGAATCTTCTACCGCACCAGGTTCTACTAGCGAATCTCCGTCTGGCAC<br>TGCTCCAGGTACTTCTCCTAGCGGTGAATCTTCTACCGCTCCAGGTACTTCCCCTAGCG<br>GCGAATCTTCTACCGCTCCAGGTTCTACTAGCTACTGCAGAATCTCCGGGCCCAGGT<br>ACCTCTCCTAGCGGTGAATCTTCTACCGCTCCAGGTACTTCTCCGAGCGGTGAATCTTC<br>TACCGCTCCAGGTTCTACTAGCTACTGCAGAATCCTGGCCCAGGTACCTCTACTC<br>CGGAAAGCGGCTCTGCATCTCCAGGTACTTCTACCCCTGAAAGCGGTTCTGCATCTCC<br>AGGTTCTACTAGCGAATCTCCTTCTGGCACTGCACCAGGTTCTACCAGCGAATCTCCGT<br>CTGGCACTGCACCAGGTACCTCTACCCCTGAAAGCGGTTCCGCTTCTCCAGGTTCTACC<br>AGCTCTACCGCAGAATCTCCTGGTCCAGGTACCTCTACTCCGGAAAGCGGCTCTGCAT<br>CTCCAGGTTCTACTAGCGAATCTCCTTCTGGCACTGCACCAGGTACTTCTCCGAGCGGT<br>GAATCTTCTACCGCACCAGGTTCTACTAGCTCTACCGCTGAATCTCCGGGCCCAGGTA<br>CTTCTCCGAGCGGTGAATCTTCTACTGCTCCAGGTACCTCTACTCCTGAAAGCGGTTCT |

TABLE 7-continued

DNA sequences of XTEN and precursor sequences

| XTEN Name | SEQ ID NO: | DNA Nucleotide Sequence |
|---|---|---|
| | | GCATCTCCAGGTTCCACTAGCTCTACCGCAGAATCTCCGGGCCCAGGTTCTACTAGCTC<br>TACTGCTGAATCTCCTGGCCCAGGTTCTACTAGCTCTACTGCTGAATCTCCGGGTCCAG<br>GTTCTACCAGCTCTACTGCTGAATCTCCTGGTCCAGGTACCTCCCCGAGCGGTGAATCT<br>TCTACTGCACCAGGTTCTACTAGCGAATCTCCTTCTGGCACTGCACCAGGTTCTACCAG<br>CGAATCTCCGTCTGGCACTGCACCAGGTACCTCTACCCCTGAAAGCGGTCCXXXXXXX<br>XXXXXTGCAAGCGCAAGCGGCGCGCCAAGCACGGGAXXXXXXXXXTAGCGAATCTCCT<br>TCTGGTACCGCTCCAGGTTCTACCAGCGAATCCCCGTCTGGTACTGCTCCAGGTTCTAC<br>CAGCGAATCTCCTTCTGGTACTGCACCAGGTTCTACTAGCGAATCTCCTTCTGGTACCG<br>CTCCAGGTTCTACCAGCGAATCCCCGTCTGGTACTGCTCCAGGTTCTACCAGCGAATCT<br>CCTTCTGGTACTGCACCAGGTACTTCTACTCCGGAAAGCGGTTCCGCATCTCCAGGTAC<br>TTCTCCTAGCGGTGAATCTTCTACTGCTCCAGGTACCTCTCCTAGCGGCGAATCTTCTA<br>CTGCTCCAGGTTCTACCAGCTCTACTGCTGAATCTCCGGGTCCAGGTACTTCCCCGAGC<br>GGTGAATCTTCTACTGCACCAGGTACTTCTACTCCGGAAAGCGGTTCCGCTTCTCCAGG<br>TTCTACCAGCGAATCTCCTTCTGGCACCGCTCCAGGTTCTACTAGCGAATCCCCGTCTG<br>GTACCGCACCAGGTACTTCTCCTAGCGGCGAATCTTCTACCGCACCAGGTTCTACTAG<br>CGAATCCCCGTCTGGTACCGCACCAGGTACTTCTACCCCGGAAAGCGGCTCTGCTTCT<br>CCAGGTACTTCTACCCCGGAAAGCGGCTCCGCATCTCCAGGTTCTACTAGCGAATCTC<br>CTTCTGGTACCGCTCCAGGTACTTCTACCCCTGAAAGCGGCTCCGCTTCTCCAGGTTCC<br>ACTAGCTCTACCGCTGAATCTCCGGGTCCAGGTTCTACCAGCGAATCTCCTTCTGGCAC<br>CGCTCCAGGTTCTACTAGCGAATCCCCGTCTGGTACCGCACCAGGTACTTCTCCTAGCG<br>GCGAATCTTCTACCGCACCAGGTTCTACCAGCTCTACTGCTGAATCTCCGGGTCCAGGT<br>ACTTCCCCGAGCGGTGAATCTTCTACTGCACCAGGTACTTCTACTCCGGAAAGCGGTT<br>CCGCTTCTCCAGGTACCTCCCCTAGCGGCGAATCTTCTACTGCTCCAGGTACCTCTCCT<br>AGCGGCGAATCTTCTACCGCTCCAGGTACCTCCCCTAGCGGTGAATCTTCTACCGCAC<br>CAGGTTCTACTAGCTCTACTGCTGAATCTCCGGGTCCAGGTTCTACCAGCTCTACTGCT<br>GAATCTCCTGGTCCAGGTACCTCCCCGAGCGGTGAATCTTCTACTGCACCAGGTTCTA<br>GCCCTTCTGCTTCCACCGGTACCGGCCCAGGTAGCTCTACTCCGTCTGGTGCAACTGGC<br>TCTCCAGGTAGCTCTACTCCGTCTGGTGCAACCGGCTCCCCA<br>XXXX was inserted in two areas where no sequence information is available. |
| AG864 | 118 | GGTGCTTCCCCGGGCACCAGCTCTACTGGTTCTCCAGGTTCTAGCCCGTCTGCTTCTAC<br>TGGTACTGGTCCAGGTTCTAGCCCTTCTGCTTCCACTGGTACTGGTCCAGGTACCCCGG<br>GTAGCGGTACCGCTTCTTCTTCTCCAGGTAGCTCTACTCCGTCTGGTGCTACCGGCTCT<br>CCAGGTTCTAACCCTTCTGCATCCACCGGTACCGGCCCAGGTGCTTCTCCGGGCACCA<br>GCTCTACTGGTTCTCCAGGTACCCCGGGCAGCGGTACCGCATCTTCTTCTCCAGGTAGC<br>TCTACTCCTTCTGGTGCAACTGGTTCTCCAGGTACTCCTGGCAGCGGTACCGCTTCTTC<br>TTCTCCAGGTGCTTCTCCTGGTACTAGCTCTACTGGTTCTCCAGGTGCTTCTCCGGGCA<br>CTAGCTCTACTGGTTCTCCAGGTACCCCGGGTAGCGGTACTGCTTCTTCCTCTCCAGGT<br>AGCTCTACCCCTTCTGGTGCAACCGGCTCTCCAGGTGCTTCTCCGGGCACCAGCTCTAC<br>CGGTTCTCCAGGTACCCCGGGTAGCGGTACCGCTTCTTCTTCTCCAGGTAGCTCTACTC<br>CGTCTGGTGCTACCGGCTCTCCAGGTTCTAACCCTTCTGCATCCACCGGTACCGGCCCA<br>GGTTCTAGCCCTTCTGCTTCCACCGGTACTGGCCCAGGTAGCTCTACCCCTTCTGGTGC<br>TACCGGCTCCCCAGGTAGCTCTACTCCTTCTGGTGCAACTGGCTCTCCAGGTGCATCTC<br>CGGGCACTAGCTCTACTGGTTCTCCAGGTGCATCCCCTGGCACTAGCTCTACTGGTTCT<br>CCAGGTGCTTCTCCTGGTACCAGCTCTACTGGTTCTCCAGGTACTCCTGGCAGCGGTAC<br>CGCTTCTTCTTCTCCAGGTGCTTCTCCTGGTACTAGCTCTACTGGTTCTCCAGGTGCTTC<br>TCCGGGCACTAGCTCTACTGGTTCTCCAGGTGCTTCCCCGGGCACTAGCTCTACCGGTT<br>CTCCAGGTTCTAGCCCTTCTGCATCTACTGGTACTGGCCCAGGTACTCCGGGCAGCGGT<br>ACTGCTTCTTCCTCTCCAGGTGCATCTCCGGGCACTAGCTCTACTGGTTCTCCAGGTGC<br>ATCCCCTGGCACTAGCTCTACTGGTTCTCCAGGTGCTTCTCCTGGTACCAGCTCTACTG<br>GTTCTCCAGGTAGCTCTACTCCGTCTGGTGCAACCGGTTCCCCAGGTAGCTCTACTCCT<br>TCTGGTGCTACTGGCTCCCCAGGTGCATCCCTGGCACCAGCTCTACCGGTTCTCCAGG<br>TACCCCGGGCAGCGGTACCGCATCTTCCTCTCCAGGTAGCTCTACCCCGTCTGGTGCTA<br>CCGGTTCCCCAGGTAGCTCTACCCCGTCTGGTGCAACCGGCTCCCCAGGTAGCTCTACT<br>CCGTCTGGTGCAACCGGCTCCCCAGGTTCTAGCCCGTCTGCTTCCACTGGTACTGGCCC<br>AGGTGCTTCCCCGGGCACCAGCTCTACTGGTTCTCCAGGTGCATCCCCGGGTACCAGC<br>TCTACCGGTTCTCCAGGTACTCCTGGCAGCGGTACTGCATCTTCCTCTCCAGGTGCTTC<br>TCCGGGCACCAGCTCTACTGGTTCTCCAGGTGCATCTCCGGGCACTAGCTCTACTGGTT<br>CTCCAGGTGCATCCCCTGGCACTAGCTCTACTGGTTCTCCAGGTGCTTCTCCTGGTACC<br>AGCTCTACTGGTTCTCCAGGTACCCCTGGTAGCGGTACTGCTTCTTCCTCTCCAGGTAG<br>CTCTACTCCGTCTGGTGCTACCGGTTCTCCAGGTACCCCGGGTAGCGGTACCGCATCTT<br>CTTCTCCAGGTAGCTCTACCCCGTCTGGTGCTACTGGTTCTCCAGGTACTCCGGGCAGC<br>GGTACTGCTTCTTCCTCTCCAGGTAGCTCTACCCCTTCTGGTGCTACTGGCTCTCCAGG<br>TAGCTCTACCCCGTCTGGTGCTACTGGCTCCCCAGGTTCTAGCCCTTCTGCATCCACCG<br>GTACCGGTCCAGGTTCTAGCCCGTCTGCATCTACTGGTACTGGTCCAGGTGCATCCCCG<br>GGCACTAGCTCTACCGGTTCTCCAGGTACTCCTGGTAGCGGTACTGCTTCTTCTTCTCC<br>AGGTAGCTCTACTCCTTCTGGTGCTACTGGTTCTCCAGGTTCTAGCCCTTCTGCATCCA<br>CCGGTACCGGCCCAGGTTCTAGCCCGTCTGCTTCTACCGGTACTGGTCCAGGTGCTTCT<br>CCGGGTACTAGCTCTACTGGTTCTCCAGGTGCATCTCCTGGTACTAGCTCTACTGGTTC<br>TCCAGGTAGCTCTACTCCGTCTGGTGCAACCGGCTCTCCAGGTTCTAGCCCTTCTGCAT<br>CTACCGGTACTGGTCCAGGTGCATCCCCTGGTACCAGCTCTACCGGTTCTCCAGGTTCT<br>AGCCCTTCTGCTTCTACCGGTACCGGTCCAGGTACCCCTGGCAGCGGTACCGCATCTTC<br>CTCTCCAGGTAGCTCTACTCCGTCTGGTGCAACCGGTTCCCCAGGTAGCTCTACTCCTT<br>CTGGTGCTACTGGCTCCCCAGGTGCATCCCCTGGCACCAGCTCTACCGGTTCTCCA |

TABLE 7-continued

DNA sequences of XTEN and precursor sequences

| XTEN Name | SEQ ID NO: | DNA Nucleotide Sequence |
|---|---|---|
| AM923 | 119 | ATGGCTGAACCTGCTGGCTCTCCAACCTCCACTGAGGAAGGTGCATCCCCGGGCACCA<br>GCTCTACCGGTTCTCCAGGTAGCTCTACCCCGTCTGGTGCTACTGGCTCTCCAGGTAGC<br>TCTACCCCGTCTGGTGCTACTGGCTCTCCAGGTACTTCTACTGAACCGTCTGAAGGCAG<br>CGCACCAGGTAGCGAACCGGCTACTTCCGGTTCTGAAACCCCAGGTAGCCCAGCAGGT<br>TCTCCAACTTCTACTGAAGAAGGTTCTACCAGCTCTACCGCAGAATCTCCTGGTCCAG<br>GTACCTCTACTCCGGAAAGCGGCTCTGCATCTCCAGGTTCTACTAGCGAATCTCCTTCT<br>GGCACTGCACCAGGTTCTACTAGCGAATCCCCGTCTGGTACTGCTCCAGGTACTTCTAC<br>TCCTGAAAGCGGTTCCGCTTCTCCAGGTACCTCTACTCCGGAAAGCGGTTCTGCATCTC<br>CAGGTAGCGAACCGGCAACCTCCGGCTCTGAAACCCCAGGTACCTCTGAAAGCGCTAC<br>TCCTGAATCCGGCCCAGGTAGCCCGGCAGGTTCTCCGACTTCCACTGAGGAAGGTACC<br>TCTACTGAACCTTCTGAGGGCAGCGCTCCAGGTACTTCTGAAAGCGCTACCCCGGAGT<br>CCGGTCCAGGTACTTCTACTGAACCGTCCGAAGGTAGCGCACCAGGTACTTCTACCGA<br>ACCGTCCGAGGGTAGCGCACCAGGTAGCCCAGCAGGTTCTCCTACCTCCACCGAGGAA<br>GGTACTTCTACCGAACCGTCCGAGGGTAGCGCACCAGGTACTTCTACCGAACCTTCCG<br>AGGGCAGCGCACCAGGTACTTCTGAAAGCGCTACCCCTGAGTCCGGCCCAGGTACTTC<br>TGAAAGCGCTACTCCTGAATCCGGTCCAGGTACCTCTACTGAACCTTCCGAAGGCAGC<br>GCTCCAGGTACCTCTACCGAACCGTCCGAGGGCAGCGCACCAGGTACTTCTGAAAGCG<br>CAACCCCTGAATCCGGTCCAGGTACTTCTACTGAACCTTCCGAAGGTAGCGCTCCAGG<br>TAGCGAACCTGCTACTTCTGGTTCTGAAACCCCAGGTAGCCGGCTGGCTCTCCGACC<br>TCCACCGAGGAAGGTAGCTCTACCCCGTCTGGTGCTACTGGTTCTCCAGGTACTCCGG<br>GCAGCGGTACTGCTTCTTCCTCTCCAGGTAGCTCTACCCCTTCTGGTGCTACTGGCTCT<br>CCAGGTACCTCTACCGAACCGTCCGAGGGTAGCGCACCAGGTACCTCTACTGAACCGT<br>CTGAGGGTAGCGCTCCAGGTAGCGAACCGGCAACCTCCGGTTCTGAAACTCCAGGTAG<br>CCCTGCTGGCTCTCCGACTTCTACTGAGGAAGGTAGCCCGGCTGGTTCTCCGACTTCTA<br>CTGAGGAAGGTACTTCTACCGAACCTTCCGAAGGTAGCGCTCCAGGTGCAAGCGCAA<br>GCGGCGCGCCAAGCACGGGAGGTACTTCTGAAAGCGCTACTCCTGAGTCCGGCCCAG<br>GTAGCCCGGCTGGCTCTCCGACTTCCACCGAGGAAGGTAGCCCGGCTGGCTCTCCAAC<br>TTTCTACTGAAGAAGGTTCTACCAGCTCTACCGCTGAATCTCCTGGCCCAGGTTCTACTA<br>GCGAATCTCCGTCTGGCACCGCACCAGGTACTTCCCCTAGCGGTGAATCTTCTACTGC<br>ACCAGGTACCCCTGGCAGCGGTACCGCTTCTTCCTCTCCAGGTAGCTCTACCCCGTCTG<br>GTGCTACTGGCTCTCCAGGTTCTAGCCCGTCTGCATCTACCGGTACCGGCCCAGGTAG<br>CGAACCGGCAACCTCCGGCTCTGAAACTCCAGGTACTTCTGAAAGCGCTACTCCGGAA<br>TCCGGCCCAGGTAGCGAACCGGCTACTTCCGGCTCTGAAACCCCAGGTTCCACCAGCT<br>CTACTGCAGAATCTCCGGGCCCAGGTTCTACTAGCTACTGCAGAATCTCCGGGTCC<br>AGGTACTTCTCCTAGCGGCGAATCTTCTACCGCTCCAGGTAGCGAACCGGCAACCTCT<br>GGCTCTGAAACTCCAGGTAGCGAACCTGCAACCTCCGGCTCTGAAACCCCAGGTACTT<br>CTACTGAACCTTCTGAGGGCAGCGCACCAGGTTCTACCAGCTCTACCGCAGAATCTCC<br>TGGTCCAGGTACCTCTACTCCGGAAAGCGGCTCTGCATCTCCAGGTTCTACTAGCGAA<br>TCTCCTTCTGGCACTGCACCAGGTACTTCTACCGAACCGTCCGAAGGCAGCGCTCCAG<br>GTACCTCTACTGAACCTTCCGAGGGCAGCGCTCCAGGTACCTCTACCGAACCTTCTGA<br>AGGTAGCGCACCAGGTAGCTCTACTCCGTCTGGTGCAACCGGCTCCCCAGGTTCTAGC<br>CCGTCTGCTTCCACTGGTACTGGCCAGGTGCTTCCCCGGGCACCAGCTCTACTGGTTC<br>TCCAGGTAGCGAACCTGCTACCTCCGGTTCTGAAACCCCAGGTACCTCTGAAAGCGCA<br>ACTCCGGAGTCTGGTCCAGGTAGCCCTGCAGGTTCTCCTACCTCCACTGAGGAAGGTA<br>GCTCTACTCCGTCTGGTGCAACCGGCTCCCCAGGTTCTAGCCCGTCTGCTTCCACTGGT<br>ACTGGCCCAGGTGCTTCCCCGGGCACCAGCTCTACTGGTTCTCCAGGTACCTCTGAAA<br>GCGCTACTCCGGAGTCTGGCCCAGGTACCTCTACTGAACCGTCTGAGGGTAGCGCTCC<br>AGGTACTTCTACTGAACCGTCCGAAGGTAGCGCACCA |
| AE912 | 120 | ATGGCTGAACCTGCTGGCTCTCCAACCTCCACTGAGGAAGGTACCCCGGGTAGCGGTA<br>CTGCTTCTTCCTCTCCAGGTAGCTCTACCCCTTCTGGTGCAACCGGCTCTCCAGGTGCT<br>TCTCCGGGCACCAGCTCTACCGGTTCTCCAGGTAGCCCGGCTGGCTCTCCTACCTCTAC<br>TGAGGAAGGTACTTCTGAAAGCGCTACTCCTGAGTCTGGTCCAGGTACCTCTACTGAA<br>CCGTCCGAAGGTAGCGCTCCAGGTAGCCCAGCAGGCTCTCCGACTTCCACTGAGGAAG<br>GTACTTCTACTGAACCTTCCGAAGGCAGCGCACCAGGTACCTCTACTGAACCTTCTGA<br>GGGCAGCGCTCCAGGTACTTCTGAAAGCGCTACCCCGGAATCTGGCCCAGGTAGCGA<br>ACCGGCTACTTCTGGTTCTGAAACCCCAGGTAGCGAACCGGCTACCTCCGGTTCTGAA<br>ACTCCAGGTAGCCCGGCAGGCTCTCCGACCTCTACTGAGGAAGGTACTTCTGAAAGCG<br>CAACCCCGGAGTCCGGCCCAGGTACCTCTACCGAACCGTCTGAGGGCAGCGCACCAG<br>GTACTTCTACCGAACCGTCCGAGGGTAGCGCACCAGGTAGCCCAGCAGGTTCTCCTAC<br>CTCCACCGAGGAAGGTACTTCTACCGAACCGTCCGAGGGTAGCGCACCAGGTACCTCT<br>ACTGAACCTTCTGAGGGCAGCGCTCCAGGTACTTCTGAAAGCGCTACCCCGGAGTCCG<br>GTCCAGGTACTTCTACTGAACCGTCCGAAGGTAGCGCACCAGGTACTTCTGAAAGCGC<br>AACCCCTGAATCCGGTCCAGGTAGCGAACCGGCTACTTCTGGCTCTGAGACTCCAGGT<br>ACTTCTACCGAACCGTCCGAAGGTAGCGCACCAGGTACTTCTACTGAACCGTCTGAAG<br>GTAGCGCACCAGGTACTTCTGAAAGCGCAACCCCGGAATCCGGCCCAGGTACCTCTGA<br>AAGCGCAACCCCGGAGTCCGGCCCAGGTAGCCCTGCTGGCTCTCAACCTCCACCGAA<br>GAAGGTACCTCTGAAAGCGCAACCCCTGAATCCGGCCCAGGTAGCGAACCGGCAACC<br>TCCGGTTCTGAAACCCCAGGTACCTCTGAAAGGTAGCTACTCCGGCTGGCCAGGTA<br>CCTCTACTGAACCGTCTGAGGGTAGCGCTCCAGGTACTTCTACTGAACCGTCCGAAGG<br>TAGCGCACCAGGTACTTCTACCGAACCGTCCGAAGGCAGCGCTCCAGGTACCTCTACT<br>GAACCTTCCGAGGGCAGCGCTCCAGGTACCTCTACCGAACCTTCTGAAGGTAGCGCAC<br>CAGGTACTTCTACCGAACCGTCCGAGGGTAGCGCACCAGGTAGCCCAGCAGGTTCTCC<br>TACCTCCACCGAGGAAGGTACTTCTACCGAACCGTCCGAGGGTAGCGCACCAGGTACC |

TABLE 7-continued

DNA sequences of XTEN and precursor sequences

| XTEN Name | SEQ ID NO: | DNA Nucleotide Sequence |
|---|---|---|
| | | TCTGAAAGCGCAACTCCTGAGTCTGGCCCAGGTAGCGAACCTGCTACCTCCGGCTCTG<br>AGACTCCAGGTACCTCTGAAAGCGCAACCCCGGAATCTGGTCCAGGTAGCGAACCTGC<br>AACCTCTGGCTCTGAAACCCCAGGTACCTCTGAAAGCGCTACTCCTGAATCTGGCCCA<br>GGTACTTCTACTGAACCGTCCGAGGGCAGCGCACCAGGTACTTCTGAAAGCGCTACTC<br>CTGAGTCCGGCCCAGGTAGCCCGGCTGGCTCTCCGACTTCCACCGAGGAAGGTAGCCC<br>GGCTGGCTCTCCAACTTCTACTGAAGAAGGTAGCCCGGCAGGCTCTCCGACCTCTACT<br>GAGGAAGGTACTTCTGAAAGCGCAACCCCGGAGTCCGGCCCAGGTACCTCTACCGAA<br>CCGTCTGAGGGCAGCGCACCAGGTACCTCTGAAAGCGCAACTCCTGAGTCTGGCCCAG<br>GTAGCGAACCTGCTACCTCCGGCTCTGAGACTCCAGGTACCTCTGAAAGCGCAACCCC<br>GGAATCTGGTCCAGGTAGCGAACCTGCAACCTCTGGCTCTGAAACCCCAGGTACCTCT<br>GAAAGCGCTACTCCTGAATCTGGCCCAGGTACTTCTACTGAACCGTCCGAGGGCAGCG<br>CACCAGGTAGCCCTGCTGGCTCTCCAACCTCCACCGAAGAAGGTACCTCTGAAAGCGC<br>AACCCCTGAATCCGGCCCAGGTAGCGAACCGGCAACCTCCGGTTCTGAAACCCCAGGT<br>ACTTCTGAAAGCGCTACTCCTGAGTCCGGCCCAGGTAGCCCGGCTGGCTCTCCGACTT<br>CCACCGAGGAAGGTAGCCCGGCTGGCTCTCCAACTTCTACTGAAGAAGGTACTTCTAC<br>CGAACCTTCCGAGGGCAGCGCACCAGGTACTTCTGAAAGCGCTACCCCTGAGTCCGGC<br>CCAGGTACTTCTGAAAGCGCTACTCCTGAATCCGGTCCAGGTACTTCTGAAAGCGCTA<br>CCCCGGAATCTGGCCCAGGTAGCGAACCGGCTACTTCTGGTTCTGAAACCCCAGGTAG<br>CGAACCGGCTACCTCCGGTTCTGAAACTCCAGGTAGCCCAGCAGGCTCTCCGACTTCC<br>ACTGAGGAAGGTACTTCTACTGAACCTTCCGAAGGCAGCGCACCAGGTACCTCTACTG<br>AACCTTCTGAGGGCAGCGCTCCAGGTAGCGAACCTGCAACCTCTGGCTCTGAAACCCC<br>AGGTACCTCTGAAAGCGCTACTCCTGAATCTGGCCCAGGTACTTCTACTGAACCGTCC<br>GAGGGCAGCGCACCA |
| AM1318 | 121 | GGTACTTCTACTGAACCGTCTGAAGGCAGCGCACCAGGTAGCGAACCGGCTACTTCCG<br>GTTCTGAAACCCCAGGTAGCCCAGCAGGTTCTCCAACTTCTACTGAAGAAGGTTCTAC<br>CAGCTCTACCGCAGAATCTCCTGGTCCAGGTACCTCTACTCCGGAAAGCGGCTCTGCA<br>TCTCCAGGTTCTACTAGCGAATCTCCTTCTGGCACTGCACCAGGTTCTACTAGCGAATC<br>CCCGTCTGGTACTGCTCCAGGTACTTCTACTCCTGAAAGCGGTTCCGCTTCTCCAGGTA<br>CCTCTACTCCGGAAAGCGGTTCTGCATCTCCAGGTAGCGAACCGGCAACCTCCGGCTC<br>TGAAACCCCAGGTACCTCTGAAAGCGCTACTCCTGAATCCGGCCCAGGTAGCCCGGCA<br>GGTTCTCCGACTTCCACTGAGGAAGGTACCTCTACTGAACCTTCTGAGGGCAGCGCTC<br>CAGGTACTTCTGAAAGCGCTACCCCGGAGTCCGGTCCAGGTACTTCTACTGAACCGTC<br>CGAAGGTAGCGCACCAGGTACTTCTACCGAACCGTCCGAGGGTAGCGCACCAGGTAG<br>CCCAGCAGGTTCTCCTACCTCCACCGAGGAAGGTACTTCTACCGAACCGTCCGAGGGT<br>AGCGCACCAGGTACTTCTACCGAACCTTCCGAGGGCAGCGCACCAGGTACTTCTGAAA<br>GCGCTACCCCTGAGTCCGCCCAGGTACTTCTGAAAGCGCTACTCCTGAATCCGGTCC<br>AGGTACCTCTACTGAACCTTCCGAAGGCAGCGCTCCAGGTACCTCTACCGAACCGTCC<br>GAGGGCAGCGCACCAGGTACTTCTGAAAGCGCAACCCCTGAATCCGGTCAGGTACTT<br>CTACTGAACCTTCCGAAGGTAGCGCTCCAGGTAGCGAACCTGCTACTTCTGGTTCTGA<br>AACCCCAGGTAGCCCGGCTGGCTCTCCGACCTCCACCGAGGAAGGTAGCTCTACCCCG<br>TCTGGTGCTACTGGTTCTCCAGGTACTCCGGGCAGCGGTACTGCTTCTTCCTCTCCAGG<br>TAGCTCTACCCCTTCTGGTGCTACTGGCTCTCCAGGTACCTCTACCGAACCGTCCGAGG<br>GTAGCGCACCAGGTACCTCTACTGAACCGTCTGAGGGTAGCGCTCCAGGTAGCGAACC<br>GGCAACCTCCGGTTCTGAAACTCCAGGTAGCCCTGCTGGCTCTCCGACTTCTACTGAG<br>GAAGGTAGCCCGGCTGGTTCTCCGACTTCTACTGAGGAAGGTACTTCTACCGAACCTT<br>CCGAAGGTAGCGCTCCAGGTCCAGAACCAACGGGGCCGGCCCCAAGCGGAGGTAGCG<br>AACCGGCAACCTCCGGCTCTGAAACCCCAGGTACCTCTGAAAGCGCTACTCCTGAATC<br>CGGCCCAGGTAGCCCGGCAGGTTCTCCGACTTCCACTGAGGAAGGTACTTCTGAAAGC<br>GCTACTCCTGAGTCCGGCCCAGGTAGCCCGGCTGGCTCTCCGACTTCCACCGAGGAAG<br>GTAGCCCGGCTGGCTCTCCAACTTCTACTGAAGAAGGTACTTCTGAAAGCGCTACTCC<br>TGAGTCCGGCCCAGGTAGCCCGGCTGGCTCTCCGACTTCCACCGAGGAAGGTAGCCCG<br>GCTGGCTCTCCAACTTCTACTGAAGAAGGTTCTACCAGCTCTACCGCTGAATCTCCTGG<br>CCCAGGTTCTACTAGCGAATCTCCGTCTGGCACCGCACCAGGTACTTCCCCTAGCGGT<br>GAATCTTCTACTGCACCAGGTTCTACCAGCGAATCTCCTTCTGGCACCGCTCCAGGTTC<br>TACTAGCGAATCCCGTCTGGTACCGCACCAGGTACTTCTCCTAGCGGCGAATCTTCTA<br>CCGCACCAGGTACTTCTACCGAACCTTCCGAGGGCAGCGCACCAGGTACTTCTGAAAG<br>CGCTACCCCTGAGTCCGGCCCAGGTACTTCTGAAAGCGCTACTCCTGAATCCGGTCCA<br>GGTAGCGAACCGGCAACCTCTGGCTCTGAAACCCCAGGTACCTCTGAAAGCGCTACTC<br>CGGAATCTGGTCCAGGTACTTCTGAAAGCGCTACTCCGGAATCCGGTCCAGGTACCTC<br>TACTGAACCTTCTGAGGGCAGCGCTCCAGGTACTTCTGAAAGCGCTACCCCGGAGTCC<br>GGTCCAGGTACTTCTACTGAACCGTCCGAAGGTAGCGCACCAGGTACCTCCCCTAGCG<br>GCGAATCTTCTACTGCTCCAGGTACCTCTCCTAGCGGCGAATCTTCTACCGCTCCAGGT<br>ACCTCCCCTAGCGGTGAATCTTCTACCGCACCAGGTACTTCTACCGAACCGTCCGAGG<br>GTAGCGCACCAGGTAGCCCAGCAGGTTCTCCTACCTCCACCGAGGAAGGTACTTCTAC<br>CGAACCGTCCGAGGGTAGCGCACCAGGTTCTAGCCCTTCTGCTTCCACCGGTACCGGC<br>CCAGGTAGCTCTACTCCGTCTGGTGCAACTGGCTCTCCAGGTAGCTCTACTCCGTCTGG<br>TGCAACCGGCTCCCAGGTAGCTCTACCCCGTCTGGTGCTACCGGCTCTCCAGGTAGC<br>TCTACCCCGTCTGGTGCAACCGGCTCCCCAGGTGCATCCCCGGGTACTAGCTCTACCG<br>GTTCTCCAGGTGCAAGCGAAGCGGCGCGCAAGCACGGGAGGTACTTCTCCGAGCG<br>GTGAATCTTCTACCGCACCAGGTTCTACTAGCTCTACCGCTGAATCTCCGGGCCCAGGT<br>ACTTCTCCGAGCGGTGAATCTTCTACTGCTCCAGGTACCTCTGAAAGCGCTACTCCGG<br>AGTCTGGCCCAGGTACCTCTACTGAACCGTCTGAGGGTAGCGCTCCAGGTACTTCTAC<br>TGAACCGTCCGAAGGTAGCGCACCAGGTTCTAGCCCTTCTGCATCTACTGGTACTGGC<br>CCAGGTAGCTCTACTCCTTCTGGTGCTACCGGCTCTCCAGGTGCTTCTCCGGGTACTAG |

TABLE 7-continued

DNA sequences of XTEN and precursor sequences

| XTEN Name | SEQ ID NO: | DNA Nucleotide Sequence |
|---|---|---|
| | | CTCTACCGGTTCTCCAGGTACTTCTACTCCGGAAAGCGGTTCCGCATCTCCAGGTACTT<br>CTCCTAGCGGTGAATCTTCTACTGCTCCAGGTACCTCTCCTAGCGGCGAATCTTCTACT<br>GCTCCAGGTACTTCTGAAAGCGCAACCCCTGAATCCGGTCCAGGTAGCGAACCGGCTA<br>CTTCTGGCTCTGAGACTCCAGGTACTTCTACCGAACCGTCCGAAGGTAGCGCACCAGG<br>TTCTACCAGCGAATCCCCTTCTGGTACTGCTCCAGGTTCTACCAGCGAATCCCCTTCTG<br>GCACCGCACCAGGTACTTCTACCCCTGAAAGCGGCTCCGCTTCTCCAGGTAGCCCGGC<br>AGGCTCTCCGACCTCTACTGAGGAAGGTACTTCTGAAAGCGCAACCCCGGAGTCCGGC<br>CCAGGTACCTCTACCGAACCGTCTGAGGGCAGCGCACCAGGTAGCCCTGCTGGCTCTC<br>CAACCTCCACCGAAGAAGGTACCTCTGAAAGCGCAACCCCTGAATCCGGCCCAGGTA<br>GCGAACCGGCAACCTCCGGTTCTGAAACCCCAGGTAGCTCTACCCCGTCTGGTGCTAC<br>CGGTTCCCCAGGTGCTTCTCCTGGTACTAGCTCTACCGGTTCTCCAGGTAGCTCTACCC<br>CGTCTGGTGCTACTGGCTCTCCAGGTTCTACTAGCGAATCCCCGTCTGGTACTGCTCCA<br>GGTACTTCCCCTAGCGGTGAATCTTCTACTGCTCCAGGTTCTACCAGCTCTACCGCAGA<br>ATCTCCGGGTCCAGGTAGCTCTACCCCTTCTGGTGCAACCGGCTCTCCAGGTGCATCCC<br>CGGGTACCAGCTCTACCGGTTCTCCAGGTACTCCGGGTAGCGGTACCGCTTCTTCCTCT<br>CCAGGTAGCCCTGCTGGCTCTCCGACTTCTACTGAGGAAGGTAGCCCGGCTGGTTCTC<br>CGACTTCTACTGAGGAAGGTACTTCTACCGAACCTTCCGAAGGTAGCGCTCCA |
| BC864 | 122 | GGTACTTCCACCGAACCATCCGAACCAGGTAGCGCAGGTACTTCCACCGAACCATCCG<br>AACCTGGCAGCGCAGGTAGCGAACCGGCAACCTCTGGTACTGAACCATCAGGTAGCG<br>GCGCATCCGAGCCTACCTCTACTGAACCAGGTAGCGAACCGGCTACCTCCGGTACTGA<br>GCCATCAGGTAGCGAACCGGCAACTTCCGGTACTGAACCATCAGGTAGCGAACCGGC<br>AACTTCCGGCACTGAACCATCAGGTAGCGGTGCATCTGAGCCGACCTCTACTGAACCA<br>GGTACTTCTACTGAACCATCTGAGCCGGGCAGCGCAGGTAGCGAACCAGCTACTTCTG<br>GCACTGAACCATCAGGTACTTCTACTGAACCATCCGAACCAGGTAGCGCAGGTAGCGA<br>ACCTGCTACCTCTGGTACTGAGCCATCAGGTAGCGAACCGGCTACCTCTGGTACTGAA<br>CCATCAGGTACTTCTACCGAACCATCCGAGCCTGGTAGCGCAGGTACTTCTACCGAAC<br>CATCCGAGCCAGGCAGCGCAGGTAGCGAACCGGCAACCTCTGGCACTGAGCCATCAG<br>GTAGCGAACCAGCAACTTCTGGTACTGAACCATCAGGTACTAGCGAGCCATCTACTTC<br>CGAACCAGGTGCAGGTAGCGGCGCATCCGAACCTACTTCCACTGAACCAGGTACTAGC<br>GAGCCATCCACCTCTGAACCAGGTGCAGGTAGCGAACCGGCAACTTCCGGCACTGAA<br>CCATCAGGTAGCGAACCGGCTACCTCTGGTACTGAACCATCAGGTACTTCTACCGAAC<br>CATCCGAGCCTGGTAGCGCAGGTACTTCTACCGAACCATCCGAGCCAGGCAGCGCAG<br>GTAGCGGTGCATCCGAGCCGACCTCTACTGAACCAGGTAGCGAACCAGCAACTTCTGG<br>CACTGAGCCATCAGGTAGCGAACCAGCTACCTCTGGTACTGAACCATCAGGTAGCGAA<br>CCGGCTACTTCCGGCACTGAACCATCAGGTAGCGAACCAGCAACCTCCGGTACTGAAC<br>CATCAGGTACTTCCACTGAACCATCCGAACCGGGTAGCGCAGGTAGCGAACCGGCAA<br>CTTCCGGCACTGAACCATCAGGTAGCGGTGCATCTGAGCCGACCTCTACTGAACCAGG<br>TACTTCTACTGAACCATCTGAGCCGGGCAGCGCAGGTAGCGAACCTGCAACCTCCGGC<br>ACTGAGCCATCAGGTAGCGGCGCATCTGAACCAACCTCTACTGAACCAGGTACTTCCA<br>CCGAACCATCTGAGCCAGGCAGCGCAGGTAGCGGCGCATCTGAACCAACCTCTACTG<br>AACCAGGTAGCGAACCAGCAACTTCTGGTACTGAACCATCAGGTAGCGGCGCATCTG<br>AGCCTACTTCCACTGAACCAGGTAGCGAACCGGCAACTTCCGGCACTGAACCATCAGG<br>TAGCGGTGCATCTGAGCCGACCTCTACTGAACCAGGTACTTCTACTGAACCATCTGAG<br>CCGGGCAGCGCAGGTAGCGAACCGGCAACTTCCGGCACTGAACCATCAGGTAGCGGT<br>GCATCTGAGCCGACCTCTACTGAACCAGGTACTTCTACTGAACCATCTGAGCCGGGCA<br>GCGCAGGTAGCGAACCAGCTACTTCTGGCACTGAACCATCAGGTACTTCTACTGAACC<br>ATCCGAACCAGGTAGCGCAGGTAGCGAACCTGCTACCTCTGGTACTGAGCCATCAGGT<br>ACTTCTACTGAACCATCCGAGCCGGGTAGCGCAGGTACTTCCACTGAACCATCTGAAC<br>CTGGTAGCGCAGGTACTTCCACTGAACCATCCGAACCAGGTAGCGCAGGTACTAGCGAACCATCCA<br>CCTCCGAACCAGGCGCAGGTAGCGGTGCATCTGAACCGACTTCTACTGAACCAGGTAC<br>TTCCACTGAACCATCTGAGCCAGGTAGCGCAGGTACTTCCACCGAACCATCCGAACCA<br>GGTAGCGCAGGTACTTCCACCGAACCATCCGAACCTGGCAGCGCAGGTAGCGAACCG<br>GCAACCTCTGGTACTGAACCATCAGGTAGCGGTGCATCCGAGCCGACCTCTACTGAAC<br>CAGGTAGCGAACCAGCAACTTCTGGCACTGAGCCATCAGGTAGCGAACCAGCTACCTC<br>TGGTACTGAACCATCAGGTAGCGAACCGGCAACCTCTGGCACTGAGCCATCAGGTAGC<br>GAACCAGCAACTTCTGGTACTGAACCATCAGGTACTAGCGAGCCATCTACTTCCGAAC<br>CAGGTGCAGGTAGCGAACCTGCAACCTCCGGCACTGAGCCATCAGGTAGCGGCGCAT<br>CTGAACCAACCTCTACTGAACCAGGTACTTCCACCGAACCATCTGAGCCAGGCAGCGC<br>AGGTAGCGAACCTGCAACCTCCGGCACTGAGCCATCAGGTAGCGGCGCATCTGAACC<br>AACCTCTACTGAACCAGGTACTTCCACCGAACCATCTGAGCCAGGCAGCGCA |
| BD864 | 123 | GGTAGCGAAACTGCTACTTCCGGCTCTGAGACTGCAGGTACTAGTGAATCCGCAACTA<br>GCGAATCTGGCGCAGGTAGCACTGCAGGCTCTGAGACTTCCACTGAAGCAGGTACTAG<br>CGAGTCCGCAACCAGCGAATCCGGCGCAGGTAGCGAAACTGCTACCTCTGGCTCCGA<br>GACTGCAGGTAGCGAAACTGCAACCTCTGGCTCTGAAACTGCAGGTACTTCCACTGAA<br>GCAAGTGAAGGCTCCGCATCAGGTACTTCCACCGAAGCAAGCGAAGGCTCCGCATCA<br>GGTACTAGTGAGTCCGCAACTAGCGAATCCGGTGCAGGTAGCGAAACCGCTACCTCTG<br>GTTCCGAAACTGCAGGTACTTCTACCGAGGCTAGCGAAGGTTCTGCATCAGGTAGCAC<br>TGCTGGTTCCGAGACTTCTACTGAAGCAGGTACTAGCGAATCTGCTACTAGCGAATCC<br>GGCGCAGGTACTAGCGAATCCGCTACCAGCGAATCCGGCGCAGGTAGCGAAACTGCA<br>ACCTCTGGTTCCGAGACTGCAGGTACTAGCGAGTCCGCTACTAGCGAATCTGGCGCAG<br>GTACTTCCACTGAAGCTAGTGAAGGTTCTGCATCAGGTAGCGAAACTGCTACTTCTGG |

TABLE 7-continued

DNA sequences of XTEN and precursor sequences

| XTEN Name | SEQ ID NO: | DNA Nucleotide Sequence |
|---|---|---|
| | | TTCCGAAACTGCAGGTAGCGAAACCGCTACCTCTGGTTCCGAAACTGCAGGTACTTCT |
| | | ACCGAGGCTAGCGAAGGTTCTGCATCAGGTAGCACTGCTGGTTCCGAGACTTCTACTG |
| | | AAGCAGGTACTAGCGAGTCCGCTACTAGCGAATCTGGCGCAGGTACTTCCACTGAAGC |
| | | TAGTGAAGGTTCTGCATCAGGTAGCGAAACTGCTACTTCTGGTTCCGAAACTGCAGGT |
| | | AGCACTGCTGGCTCCGAGACTTCTACCGAAGCAGGTAGCACTGCAGGTTCCGAAACTT |
| | | CCACTGAAGCAGGTAGCGAAACTGCTACCTCTGGCTCTGAGACTGCAGGTACTAGCGA |
| | | ATCTGCTACTAGCGAATCCGGCGCAGGTACTAGCGAATCCGCTACCAGCGAATCCGGC |
| | | GCAGGTAGCGAAACTGCAACCTCTGGTTCCGAGACTGCAGGTACTAGCGAATCTGCTA |
| | | CTAGCGAATCCGGCGCAGGTACTAGCGAATCCGCTACCAGCGAATCCGGCGCAGGTA |
| | | GCGAAACTGCAACCTCTGGTTCCGAGACTGCAGGTAGCGAAACCGCTACCTCTGGTTC |
| | | CGAAACTGCAGGTACTTCTACCGAGGCTAGCGAAGGTTCTGCATCAGGTAGCACTGCT |
| | | GGTTCCGAGACTTCTACTGAAGCAGGTAGCGAAACTGCTACTTCCGGCTCTGAGACTG |
| | | CAGGTACTAGTGAATCCGCAACTAGCGAATCTGGCGCAGGTAGCACTGCAGGCTCTGA |
| | | GACTTCCACTGAAGCAGGTAGCACTGCTGGTTCCGAAACCTCTACCGAAGCAGGTAGC |
| | | ACTGCAGGTTCTGAAACCTCCACTGAAGCAGGTACTTCCACTGAGGCTAGTGAAGGCT |
| | | CTGCATCAGGTAGCACTGCTGGTTCCGAAACCTCTACCGAAGCAGGTAGCACTGCAGG |
| | | TTCTGAAACCTCCACTGAAGCAGGTACTTCCACTGAGGCTAGTGAAGGCTCTGCATCA |
| | | GGTAGCACTGCAGGTTCTGAGACTTCCACCGAAGCAGGTAGCGAAACTGCTACTTCTG |
| | | GTTCCGAAACTGCAGGTACTTCCACTGAAGCTAGTGAAGGTTCCGCATCAGGTACTAG |
| | | TGAGTCCGCAACCAGCGAATCCGGCGCAGGTAGCGAAACCGCAACCTCCGGTTCTGA |
| | | AACTGCAGGTACTAGCGAATCCGCAACCAGCGAATCTGGCGCAGGTACTAGTGAGTC |
| | | CGCAACCAGCGAATCCGGCGCAGGTAGCGAAACCGCAACCTCCGGTTCTGAAACTGC |
| | | AGGTACTAGCGAATCCGCAACCAGCGAATCTGGCGCAGGTAGCGAAACTGCTACTTCC |
| | | GGCTCTGAGACTGCAGGTACTTCCACCGAAGCAAGCGAAGGTTCCGCATCAGGTACTT |
| | | CCACCGAGGCTAGTGAAGGCTCTGCATCAGGTAGCACTGCTGGCTCCGAGACTTCTAC |
| | | CGAAGCAGGTAGCACTGCAGGTTCCGAAACTTCCACTGAAGCAGGTAGCGAAACTGC |
| | | TACCTCTGGCTCTGAGACTGCAGGTACTAGCGAATCTGCTACTAGCGAATCCGGCGCA |
| | | GGTACTAGCGAATCCGCTACCAGCGAATCCGGCGCAGGTAGCGAAACTGCAACCTCT |
| | | GGTTCCGAGACTGCAGGTAGCGAAACTGCTACTTCCGGCTCCGAGACTGCAGGTAGCG |
| | | AAACTGCTACTTCTGGCTCCGAAACTGCAGGTACTTCTACTGAGGCTAGTGAAGGTTC |
| | | CGCATCAGGTACTAGCGAGTCCGCAACCAGCGAATCCGGCGCAGGTAGCGAAACTGC |
| | | TACCTCTGGCTCCGAGACTGCAGGTAGCGAAACTGCAACCTCTGGCTCTGAAACTGCA |
| | | GGTACTAGCGAATCTGCTACTAGCGAATCCGGCGCAGGTACTAGCGAATCCGCTACCA |
| | | GCGAATCCGGCGCAGGTAGCGAAACTGCAACCTCTGGTTCCGAGACTGCA |

One may clone the library of XTEN-encoding genes into one or more expression vectors known in the art. To facilitate the identification of well-expressing library members, one can construct the library as fusion to a reporter protein. Non-limiting examples of suitable reporter genes are green fluorescent protein, luciferase, alkaline phosphatase, and beta-galactosidase. By screening, one can identify short XTEN sequences that can be expressed in high concentration in the host organism of choice. Subsequently, one can generate a library of random XTEN dimers and repeat the screen for high level of expression. Subsequently, one can screen the resulting constructs for a number of properties such as level of expression, protease stability, or binding to antiserum.

One aspect of the invention is to provide polynucleotide sequences encoding the components of the fusion protein wherein the creation of the sequence has undergone codon optimization. Of particular interest is codon optimization with the goal of improving expression of the polypeptide compositions and to improve the genetic stability of the encoding gene in the production hosts. For example, codon optimization is of particular importance for XTEN sequences that are rich in glycine or that have very repetitive amino acid sequences. Codon optimization is performed using computer programs (Gustafsson, C., et al. (2004) Trends Biotechnol, 22: 346-53), some of which minimize ribosomal pausing (Coda Genomics Inc.). In one embodiment, one can perform codon optimization by constructing codon libraries where all members of the library encode the same amino acid sequence but where codon usage is varied. Such libraries can be screened for highly expressing and genetically stable members that are particularly suitable for the large-scale production of XTEN-containing products. When designing XTEN sequences one can consider a number of properties. One can minimize the repetitiveness in the encoding DNA sequences. In addition, one can avoid or minimize the use of codons that are rarely used by the production host (e.g. the AGG and AGA arginine codons and one leucine codon in E. coli). In the case of E. coli, two glycine codons, GGA and GGG, are rarely used in highly expressed proteins. Thus codon optimization of the gene encoding XTEN sequences can be very desirable. DNA sequences that have a high level of glycine tend to have a high GC content that can lead to instability or low expression levels. Thus, when possible, it is preferred to choose codons such that the GC-content of XTEN-encoding sequence is suitable for the production organism that will be used to manufacture the XTEN.

Optionally, the full-length XTEN-encoding gene comprises one or more sequencing islands. In this context, sequencing islands are short-stretch sequences that are distinct from the XTEN library construct sequences and that include a restriction site not present or expected to be present in the full-length XTEN-encoding gene. In one embodiment, a sequencing island is the sequence 5'-AGGTGCAAGCG-CAAGCGGCGCGCCAAGCACGGGAGGT-3' (SEQ ID NO: 124). In another embodiment, a sequencing island is the sequence 5'-AGGTCCAGAACCAACGGGGCCGGC-CCCAAGCGGAGGT-3' (SEQ ID NO: 125).

As an alternative, one can construct codon libraries where all members of the library encode the same amino acid sequence but where codon usage for the respective amino acids in the sequence is varied. Such libraries can be screened for highly expressing and genetically stable members that are particularly suitable for the large-scale production of XTEN-containing products.

Optionally, one can sequence clones in the library to eliminate isolates that contain undesirable sequences. The initial library of short XTEN sequences allows some variation in amino acid sequence. For instance one can randomize some codons such that a number of hydrophilic amino acids can occur in a particular position. During the process of iterative multimerization one can screen the resulting library members for other characteristics like solubility or protease resistance in addition to a screen for high-level expression.

Figure 2:
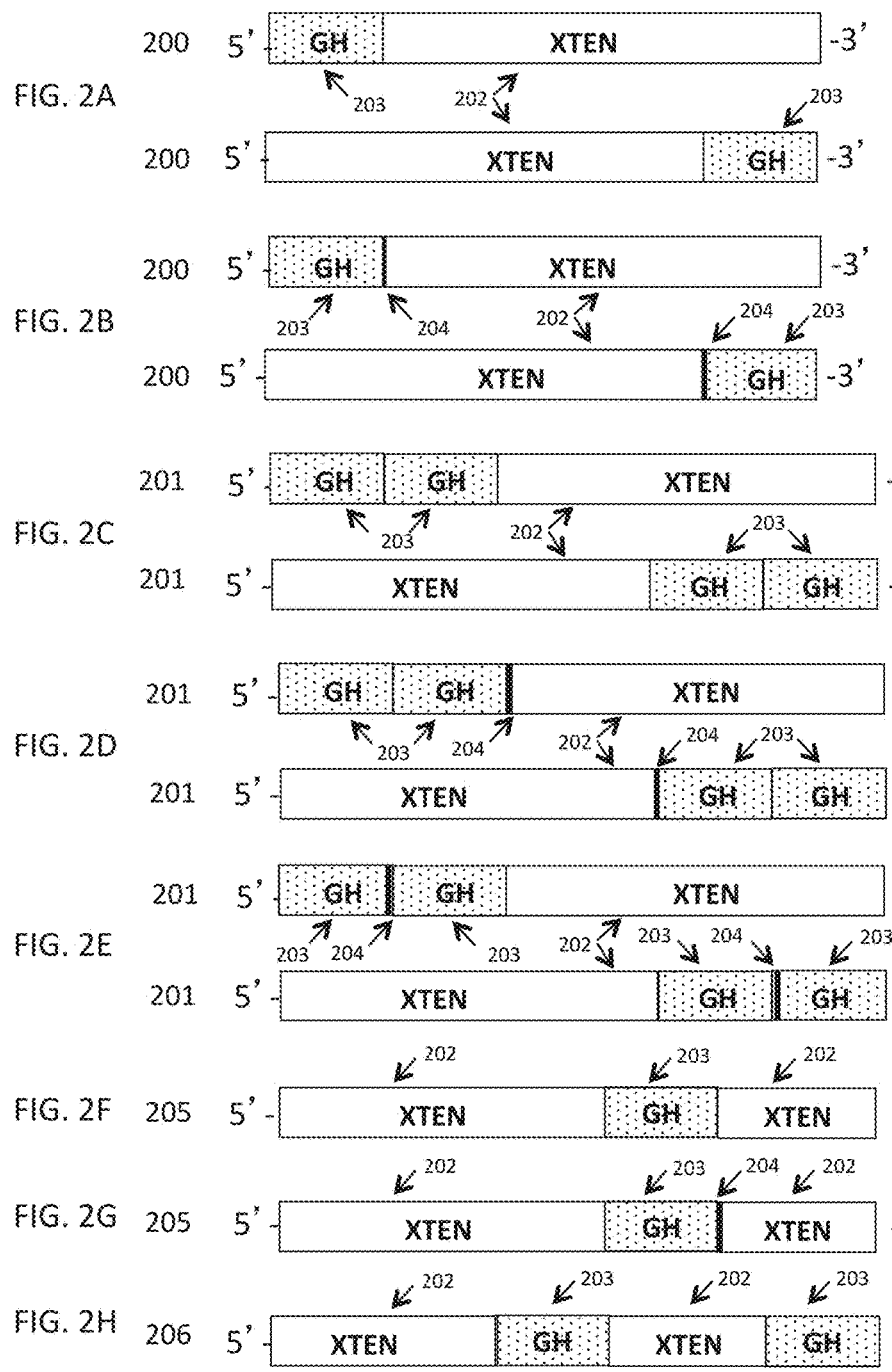
FIG. 2 is a schematic illustration of exemplary polynucleotide constructs (FIGS. 2A-H) of GHXTEN genes that encode the corresponding GHXTEN polypeptides of FIG. 1; all depicted in a 5' to 3' orientation. In these illustrative examples the genes encode GHXTEN fusion proteins with one GH and XTEN (200); or one GH, one spacer sequence and one XTEN (200); two GH and one XTEN (201); or two GH, a spacer sequence and one XTEN (201); one GH and two XTEN (205); or two GH and two XTEN (206). In these depictions, the polynucleotides encode the following components: XTEN (202), GH (203), and spacer amino acids that can include a cleavage sequence (204), with all sequences linked in frame.

Once the gene that encodes the XTEN of desired length and properties is selected, it is genetically fused to the nucleotides encoding the N- and/or the C-terminus of the GH gene(s) by cloning it into the construct adjacent and in frame with the gene coding for GH or, optionally, adjacent to a spacer sequence. The invention provides various permutations of the foregoing, depending on the GHXTEN to be encoded. For example, a gene encoding a GHXTEN fusion protein comprising a GH and two XTEN, such as embodied by formula VI, as depicted above, the gene would have polynucleotides encoding GH, encoding two XTEN, which can be identical or different in composition and sequence length. In one non-limiting embodiment of the foregoing, the GH polynucleotides would encode human growth hormone and the polynucleotides encoding the N-terminus XTEN would encode AE912 and the polynucleotides encoding the C-terminus XTEN would encode AE144. The step of cloning the GH genes into the XTEN construct can occur through a ligation or multimerization step. As shown in FIG. 2, the constructs encoding GHXTEN fusion proteins can be designed in different configurations of the components XTEN 202, GH 203, and spacer sequences 204. In one embodiment, as illustrated in FIG. 2A, the construct comprises polynucleotide sequences complementary to, or those that encode a monomeric polypeptide of components in the following order (5' to 3') GH 203 and XTEN 202, or the reverse order. In another embodiment, as illustrated in FIG. 2B, the construct comprises polynucleotide sequences complementary to, or those that encode a monomeric polypeptide of components in the following order (5' to 3') GH 203, spacer sequence 204, and XTEN 202, or the reverse order. In another embodiment, as illustrated in FIG. 2C, the construct 201 encodes a monomeric GHXTEN comprising polynucleotide sequences complementary to, or those that encode components in the following order (5' to 3'): two molecules of GH 203 and XTEN 202, or the reverse order.

In another embodiment, as illustrated in FIG. 2D, the construct comprises polynucleotide sequences complementary to, or those that encode a monomeric polypeptide of components in the following order (5' to 3'): two molecules of GH 203, spacer sequence 204, and XTEN 202, or the reverse order. In another embodiment, as illustrated in FIG. 2E, the construct comprises polynucleotide sequences complementary to, or those that encode a monomeric polypeptide of components in the following order (5' to 3'): GH 203, spacer sequence 204, a second molecule of GH 203, and XTEN 202, or the reverse order. In another embodiment, as illustrated in FIG. 2F, the construct comprises polynucleotide sequences complementary to, or those that encode a monomeric polypeptide of components in the following order (5' to 3'): GH 203, XTEN 202, GH 203, and a second XTEN 202, or the reverse sequence. The spacer polynucleotides can optionally comprise sequences encoding cleavage sequences. As will be apparent to those of skill in the art, other permutations of the foregoing are possible.

The invention also encompasses polynucleotides comprising XTEN-encoding polynucleotide variants that have a high percentage of sequence identity to (a) a polynucleotide sequence from Table 7, or (b) sequences that are complementary to the polynucleotides of (a). A polynucleotide with a high percentage of sequence identity is one that has at least about an 80% nucleic acid sequence identity, alternatively at least about 81%, alternatively at least about 82%, alternatively at least about 83%, alternatively at least about 84%, alternatively at least about 85%, alternatively at least about 86%, alternatively at least about 87%, alternatively at least about 88%, alternatively at least about 89%, alternatively at least about 90%, alternatively at least about 91%, alternatively at least about 92%, alternatively at least about 93%, alternatively at least about 94%, alternatively at least about 95%, alternatively at least about 96%, alternatively at least about 97%, alternatively at least about 98%, and alternatively at least about 99% nucleic acid sequence identity to (a) or (b) of the foregoing, or that can hybridize with the target polynucleotide or its complement under stringent conditions.

Homology, sequence similarity or sequence identity of nucleotide or amino acid sequences may also be determined conventionally by using known software or computer programs such as the BestFit or Gap pairwise comparison programs (GCG Wisconsin Package, Genetics Computer Group, 575 Science Drive, Madison, Wis. 53711). BestFit uses the local homology algorithm of Smith and Waterman (Advances in Applied Mathematics. 1981. 2: 482-489), to find the best segment of identity or similarity between two sequences. Gap performs global alignments: all of one sequence with all of another similar sequence using the method of Needleman and Wunsch, (Journal of Molecular Biology. 1970. 48:443-453). When using a sequence alignment program such as BestFit, to determine the degree of sequence homology, similarity or identity, the default setting may be used, or an appropriate scoring matrix may be selected to optimize identity, similarity or homology scores.

Nucleic acid sequences that are "complementary" are those that are capable of base-pairing according to the standard Watson-Crick complementarity rules. As used herein, the term "complementary sequences" means nucleic acid sequences that are substantially complementary, as may be assessed by the same nucleotide comparison set forth above, or as defined as being capable of hybridizing to the polynucleotides that encode the GHXTEN sequences under stringent conditions, such as those described herein.

The resulting polynucleotides encoding the GHXTEN chimeric fusion proteins can then be individually cloned into an expression vector. The nucleic acid sequence is inserted into the vector by a variety of procedures. In general, DNA is inserted into an appropriate restriction endonuclease site (s) using techniques known in the art. Vector components generally include, but are not limited to, one or more of a signal sequence, an origin of replication, one or more marker genes, an enhancer element, a promoter, and a transcription termination sequence. Construction of suitable vectors containing one or more of these components employs standard ligation techniques which are known to the skilled artisan. Such techniques are well known in the art and well described in the scientific and patent literature.

Various vectors are publicly available. The vector may, for example, be in the form of a plasmid, cosmid, viral particle, or phage. The invention provides for the use of plasmid vectors containing replication and control sequences that are compatible with and recognized by the host cell, and are operably linked to the GHXTEN gene for controlled expression of the GHXTEN fusion proteins. The vector ordinarily carries a replication site, as well as sequences that encode proteins that are capable of providing phenotypic selection in transformed cells. Such vector sequences are well known for a variety of bacteria, yeast, and viruses. Useful expression vectors that can be used include, for example, segments of chromosomal, non-chromosomal and synthetic DNA sequences. "Expression vector" refers to a DNA construct containing a DNA sequence that is operably linked to a suitable control sequence capable of effecting the expression of the DNA encoding the fusion protein in a suitable host. Such control sequences include a promoter to effect transcription, an optional operator sequence to control such transcription, a sequence encoding suitable mRNA ribosome binding sites, and sequences that control termination of transcription and translation. Other suitable vectors include, but are not limited to, derivatives of SV40 and pcDNA and known bacterial plasmids such as col EI, pCR1, pBR322, pMal-C2, pET, pGEX as described by Smith, et al., Gene 57:31-40 (1988), pMB9 and derivatives thereof, plasmids such as RP4, phage DNAs such as the numerous derivatives of phage I such as NM98 9, as well as other phage DNA such as M13 and filamentous single stranded phage DNA; yeast plasmids such as the 2 micron plasmid or derivatives of the 2 m plasmid, as well as centomeric and integrative yeast shuttle vectors; vectors useful in eukaryotic cells such as vectors useful in insect or mammalian cells; vectors derived from combinations of plasmids and phage DNAs, such as plasmids that have been modified to employ phage DNA or the expression control sequences; and the like. The requirements are that the vectors are replicable and viable in the host cell of choice. Low- or high-copy number vectors may be used as desired.

Promoters suitable for use in expression vectors with prokaryotic hosts include the β-lactamase and lactose promoter systems [Chang et al., Nature, 275:615 (1978); Goeddel et al., Nature, 281:544 (1979)], alkaline phosphatase, a tryptophan (trp) promoter system [Goeddel, Nucleic Acids Res., 8:4057 (1980); EP 36,776], and hybrid promoters such as the tac promoter [deBoer et al., Proc. Natl. Acad. Sci. USA, 80:21-25 (1983)], all would be operably linked to the DNA encoding GHXTEN polypeptides. Promoters for use in bacterial systems can also contain a Shine-Dalgarno (S.D.) sequence, operably linked to the DNA encoding GHXTEN polypeptides.

The invention contemplates use of other expression systems including, for example, a baculovirus expression system with both non-fusion transfer vectors, such as, but not limited to pVL941 Summers, et al., Virology 84:390-402 (1978)), pVL1393 (Invitrogen), pVL1392 (Summers, et al., Virology 84:390-402 (1978) and Invitrogen) and pBlueBacIII (Invitrogen), and fusion transfer vectors such as, but not limited to, pAc700 (Summers, et al., Virology 84:390-402 (1978)), pAc701 and pAc70-2 (same as pAc700, with different reading frames), pAc360 Invitrogen) and pBlueBacHisA, B, C (Invitrogen) can be used.

Mammalian expression vectors can comprise an origin of replication, a suitable promoter and enhancer, and also any necessary ribosome binding sites, polyadenylation site, splice donor and acceptor sites, transcriptional termination sequences, and 5' flanking nontranscribed sequences. DNA sequences derived from the SV40 splice, and polyadenylation sites may be used to provide the required nontranscribed genetic elements. Mammalian expression vectors contemplated for use in the invention include vectors with inducible promoters, such as the dihydrofolate reductase promoters, any expression vector with a DHFR expression cassette or a DHFR/methotrexate co-amplification vector such as pED (Randal J. Kaufman, 1991, Randal J. Kaufman, Current Protocols in Molecular Biology, 16,12 (1991)). Alternatively a glutamine synthetase/methionine sulfoximine co-amplification vector, such as pEE14 (Celltech). A vector that directs episomal expression under the control of the Epstein Barr Virus (EBV) or nuclear antigen (EBNA) can be used such as pREP4 (Invitrogen), pCEP4 (Invitrogen), pMEP4 (Invitrogen), pREP8 (Invitrogen), pREP9 (Invitrogen), and pEBVHis (Invitrogen).

Selectable mammalian expression vectors for use in the invention include, but are not limited to, pRc/CMV (Invitrogen), pRc/RSV (Invitrogen) and the like. Vaccinia virus mammalian expression vectors (see, for example, Randall J. Kaufman, Current Protocols in Molecular Biology 16.12 (Frederick M. Ausubel, et al., eds. Wiley 1991) that can be used in the present invention include, but are not limited to, pSC11, pMJ601 pTKgptF1Sand the like.

Yeast expression systems that can also be used in the present invention include, but are not limited to, the non-fusion pYES2 vector (Invitrogen), the fusion pYESHisA, B, C (Invitrogen), pRS vectors and the like.

In addition, the expression vector containing the chimeric GHXTEN fusion protein-encoding polynucleotide molecule may include drug selection markers. Such markers aid in cloning and in the selection or identification of vectors containing chimeric DNA molecules. For example, genes that confer resistance to neomycin, puromycin, hygromycin, dihydrofolate reductase (DHFR) inhibitor, guanine phosphoribosyl transferase (GPT), zeocin, and histidinol are useful selectable markers. Alternatively, enzymes such as herpes simplex virus thymidine kinase (tk) or chloramphenicol acetyltransferase (CAT) may be employed. Immunologic markers also can be employed. Any known selectable marker may be employed so long as it is capable of being expressed simultaneously with the nucleic acid encoding a gene product. Further examples of selectable markers are well known to one of skill in the art and include reporters such as enhanced green fluorescent protein (EGFP), beta-galactosidase (β-gal) or chloramphenicol acetyltransferase (CAT).

In one embodiment, the polynucleotide encoding a GHXTEN fusion protein composition is fused C-terminally to an N-terminal signal sequence appropriate for the expression host system. Signal sequences are typically proteolytically removed from the protein during the translocation and secretion process, generating a defined N-terminus. A wide variety of signal sequences have been described for most expression systems, including bacterial, yeast, insect, and mammalian systems. A non-limiting list of preferred examples for each expression system follows herein. Preferred signal sequences are OmpA, PhoA, and DsbA for *E. coli* expression. Signal peptides preferred for yeast expression are ppL-alpha, DEX4, invertase signal peptide, acid phosphatase signal peptide, CPY, or INU1. For insect cell expression the preferred signal sequences are sexta adipokinetic hormone precursor, CP1, CP2, CP3, CP4, TPA, PAP, or gp67. For mammalian expression the preferred signal sequences are IL2 L, SV40, IgG kappa and IgG lambda.

In another embodiment, a leader sequence, potentially comprising a well-expressed, independent protein domain, can be fused to the N-terminus of the GHXTEN sequence, separated by a protease cleavage site. While any leader peptide sequence which does not inhibit cleavage at the designed proteolytic site can be used, sequences in preferred embodiments will comprise stable, well-expressed sequences such that expression and folding of the overall composition is not significantly adversely affected, and preferably expression, solubility, and/or folding efficiency are significantly improved. A wide variety of suitable leader sequences have been described in the literature. A non-limiting list of suitable sequences includes maltose binding protein, cellulose binding domain, glutathione S-transferase, 6×His tag (SEQ ID NO: 126), FLAG tag, hemaglutinin tag, and green fluorescent protein. The leader sequence can also be further improved by codon optimization, especially in the second codon position following the ATG start codon, by methods well described in the literature and hereinabove.

Various in vitro enzymatic methods for cleaving proteins at specific sites are known. Such methods include use of enterokinase (DDDK (SEQ ID NO: 127)), Factor Xa (IDGR (SEQ ID NO: 128)), thrombin (LVPRGS (SEQ ID NO: 129)), PreScission™ (LEVLFQGP (SEQ ID NO: 130)), TEV protease (EQLYFQG (SEQ ID NO: 131)), 3C protease (ETLFQGP (SEQ ID NO: 132)), Sortase A (LPETG (SEQ ID NO: 133)), Granzyme B (D/X, N/X, M/N or SA), inteins, SUMO, DAPase (TAGZyme™), *Aeromonas* aminopeptidase, Aminopeptidase M, and carboxypeptidases A and B. Additional methods are disclosed in Arnau, et al., Protein Expression and Purification 48: 1-13 (2006).

In other cases, the invention provides constructs and methods of making constructs comprising an polynucleotide sequence optimized for expression that encodes at least about 20 to about 60 amino acids with XTEN characteristics that can be included at the N-terminus of an XTEN carrier encoding sequence (in other words, the polynucleotides encoding the 20-60 encoded optimized amino acids are linked in frame to polynucleotides encoding an XTEN component that is N-terminal to GH) to promote the initiation of translation to allow for expression of XTEN fusions at the N-terminus of proteins without the presence of a helper domain. In an advantage of the foregoing, the sequence does not require subsequent cleavage, thereby reducing the number of steps to manufacture XTEN-containing compositions. As described in more detail in the Examples, the optimized N-terminal sequence has attributes of an unstructured protein, but may include nucleotide bases encoding amino acids selected for their ability to promote initiation of translation and enhanced expression. In one embodiment of the foregoing, the optimized polynucleotide encodes an XTEN sequence with at least about 90% sequence identity to AE912. In another embodiment of the foregoing, the optimized polynucleotide encodes an XTEN sequence with at least about 90% sequence identity to AM923. In another embodiment of the foregoing, the optimized polynucleotide encodes an XTEN sequence with at least about 90% sequence identity to AE48. In another embodiment of the foregoing, the optimized polynucleotide encodes an XTEN sequence with at least about 90% sequence identity to AM48. In one embodiment, the optimized polynucleotide NTS comprises a sequence that exhibits at least about 80%, at least about 85%, at least about 90%, at least about 91%, at least about 92%, at least about 93%, at least about 94%, at least about 95%, at least about 96%, at least about 97%, at least about 98%, or at least about 99%, sequence identity to a sequence or its complement selected from

AE 48:
(SEQ ID NO: 134)
5'-ATGGCTGAACCTGCTGGCTCTCCAACCTCCACTGAGGAAGGTACCCC

GGGTAGCGGTACTGCTTCTTCCTCTCCAGGTAGCTCTACCCCTTCTGGTG

CAACCGGCTCTCCAGGTGCTTCTCCGGGCACCAGCTCTACCGGTTCTCC

A-3'
and

AM 48:
(SEQ ID NO: 135)
5'-ATGGCTGAACCTGCTGGCTCTCCAACCTCCACTGAGGAAGGTGCATC

CCCGGGCACCAGCTCTACCGGTTCTCCAGGTAGCTCTACCCCGTCTGGTG

CTACCGGCTCTCCAGGTAGCTCTACCCCGTCTGGTGCTACTGGCTCTCC

A-3'

In another embodiment, the protease site of the leader sequence construct is chosen such that it is recognized by an in vivo protease. In this embodiment, the protein is purified from the expression system while retaining the leader by avoiding contact with an appropriate protease. The full-length construct is then injected into a patient. Upon injection, the construct comes into contact with the protease specific for the cleavage site and is cleaved by the protease. In the case where the uncleaved protein is substantially less active than the cleaved form, this method has the beneficial effect of allowing higher initial doses while avoiding toxicity, as the active form is generated slowly in vivo. Some non-limiting examples of in vivo proteases which are useful for this application include tissue kallikrein, plasma kallikrein, trypsin, pepsin, chymotrypsin, thrombin, and matrix metalloproteinases, or the proteases of Table 6.

In this manner, a chimeric DNA molecule coding for a monomeric GHXTEN fusion protein is generated within the construct. Optionally, this chimeric DNA molecule may be transferred or cloned into another construct that is a more appropriate expression vector. At this point, a host cell capable of expressing the chimeric DNA molecule can be transformed with the chimeric DNA molecule. The vectors containing the DNA segments of interest can be transferred into the host cell by well-known methods, depending on the type of cellular host. For example, calcium chloride transfection is commonly utilized for prokaryotic cells, whereas calcium phosphate treatment, lipofection, or electroporation may be used for other cellular hosts. Other methods used to transform mammalian cells include the use of polybrene, protoplast fusion, liposomes, electroporation, and microinjection. See, generally, Sambrook, et al., supra.

The transformation may occur with or without the utilization of a carrier, such as an expression vector. Then, the transformed host cell is cultured under conditions suitable for expression of the chimeric DNA molecule encoding of GHXTEN.

The present invention also provides a host cell for expressing the monomeric fusion protein compositions disclosed herein. Examples of suitable eukaryotic host cells include, but are not limited to mammalian cells, such as VERO cells, HELA cells such as ATCC No. CCL2, CHO cell lines, COS cells, WI38 cells, BHK cells, HepG2 cells, 3T3 cells, A549 cells, PC12 cells, K562 cells, 293 cells, Sf9 cells and CvI cells. Examples of suitable non-mammalian eukaryotic cells include eukaryotic microbes such as filamentous fungi or yeast are suitable cloning or expression hosts for encoding vectors. *Saccharomyces cerevisiae* is a commonly used lower eukaryotic host microorganism. Others include *Schizosaccharomyces pombe* (Beach and Nurse, Nature, 290: 140 [1981]; EP 139,383 published 2 May 1985); *Kluyveromyces* hosts (U.S. Pat. No. 4,943,529; Fleer et al., Bio/Technology, 9:968-975 (1991)) such as, e.g., *K. lactis* (MW98-8C, CBS683, CBS4574; Louvencourt et al., J. Bacteriol., 737 [1983]), *K. fragilis* (ATCC 12,424), *K. bulgaricus* (ATCC 16,045), *K. wickeramii* (ATCC 24,178), *K. waltii* (ATCC 56,500), *K. drosophilarum* (ATCC 36,906; Van den Berg et al., Bio/Technology, 8:135 (1990)), *K. thermotolerans*, and *K. marxianus; yarrowia* (EP 402,226); *Pichia pastoris* (EP 183,070; Sreekrishna et al., J. Basic Microbiol., 28:265-278 [1988]); *Candida; Trichoderma reesia* (EP 244,234); *Neurospora crassa* (Case et al., Proc. Natl. Acad. Sci. USA, 76:5259-5263 [1979]); *Schwanniomyces* such as *Schwanniomyces occidentalis* (EP 394,538 published 31 Oct. 1990); and filamentous fungi such as, e.g., *Neurospora, Penicillium, Tolypocladium* (WO 91/00357 published 10 Jan. 1991), and *Aspergillus* hosts such as *A. nidulans* (Ballance et al., Biochem. Biophys. Res. Commun., 112:284-289 [1983]; Tilburn et al., Gene, 26:205-221 [1983]; Yelton et al., Proc. Natl. Acad. Sci. USA, 81: 1470-1474 [1984]) and *A. niger* (Kelly and Hynes, EMBO J., 4:475-479 [1985]). Methylotropic yeasts are suitable herein and include, but are not limited to, yeast capable of growth on methanol selected from the genera consisting of *Hansenula, Candida, Kloeckera, Pichia, Saccharomyces, Torulopsis*, and *Rhodotorula*. A list of specific species that are exemplary of this class of yeasts may be found in C. Anthony, The Biochemistry of Methylotrophs, 269 (1982).

Other suitable cells that can be used in the present invention include, but are not limited to, prokaryotic host cells strains such as *Escherichia coli*, (e.g., strain DH5-α), *Bacillus subtilis, Salmonella typhimurium*, or strains of the genera of *Pseudomonas, Streptomyces* and *Staphylococcus*. Non-limiting examples of suitable prokaryotes include those from the genera: *Actinoplanes; Archaeoglobus; Bdellovibrio; Borrelia; Chloroflexus; Enterococcus; Escherichia; Lactobacillus; Listeria; Oceanobacillus; Paracoccus; Pseudomonas; Staphylococcus; Streptococcus; Streptomyces; Thermoplasma*; and *Vibrio*. Non-limiting examples of specific strains include: *Archaeoglobus fulgidus; Bdellovibrio bacteriovorus; Borrelia burgdorferi; Chloroflexus aurantiacus; Enterococcus faecalis; Enterococcus faecium; Lactobacillus johnsonii; Lactobacillus plantarum; Lactococcus lactis; Listeria innocua; Listeria monocytogenes; Oceanobacillus iheyensis; Paracoccus zeaxanthinifaciens; Pseudomonas mevalonii; Staphylococcus aureus; Staphylococcus epidermidis; Staphylococcus haemolyticus; Streptococcus agalactiae; Streptomyces griseolosporeus; Streptococcus mutans; Streptococcus pneumoniae; Streptococcus pyogenes; Thermoplasma acidophilum; Thermoplasma volcanium; Vibrio cholerae; Vibrio parahaemolyticus*; and *Vibrio vulnificus*.

Host cells containing the polynucleotides of interest can be cultured in conventional nutrient media (e.g., Ham's nutrient mixture) modified as appropriate for activating promoters, selecting transformants or amplifying genes. The culture conditions, such as temperature, pH and the like, are those previously used with the host cell selected for expression, and will be apparent to the ordinarily skilled artisan. Cells are typically harvested by centrifugation, disrupted by physical or chemical means, and the resulting crude extract retained for further purification. For compositions secreted by the host cells, supernatant from centrifugation is separated and retained for further purification. Microbial cells employed in expression of proteins can be disrupted by any convenient method, including freeze-thaw cycling, sonication, mechanical disruption, or use of cell lysing agents, all of which are well known to those skilled in the art. Embodiments that involve cell lysis may entail use of a buffer that contains protease inhibitors that limit degradation after expression of the chimeric DNA molecule. Suitable protease inhibitors include, but are not limited to leupeptin, pepstatin or aprotinin. The supernatant then may be precipitated in successively increasing concentrations of saturated ammonium sulfate.

Gene expression may be measured in a sample directly, for example, by conventional Southern blotting, Northern blotting to quantitate the transcription of mRNA [Thomas, Proc. Natl. Acad. Sci. USA, 77:5201-5205 (1980)], dot blotting (DNA analysis), or in situ hybridization, using an appropriately labeled probe, based on the sequences provided herein. Alternatively, antibodies may be employed that can recognize specific duplexes, including DNA duplexes, RNA duplexes, and DNA-RNA hybrid duplexes or DNA-protein duplexes. The antibodies in turn may be labeled and the assay may be carried out where the duplex is bound to a surface, so that upon the formation of duplex on the surface, the presence of antibody bound to the duplex can be detected.

Gene expression, alternatively, may be measured by immunological of fluorescent methods, such as immunohistochemical staining of cells or tissue sections and assay of cell culture or body fluids or the detection of selectable markers, to quantitate directly the expression of gene product. Antibodies useful for immunohistochemical staining and/or assay of sample fluids may be either monoclonal or polyclonal, and may be prepared in any mammal Conveniently, the antibodies may be prepared against a native sequence GH polypeptide or against a synthetic peptide based on the DNA sequences provided herein or against exogenous sequence fused to GH and encoding a specific antibody epitope. Examples of selectable markers are well known to one of skill in the art and include reporters such as enhanced green fluorescent protein (EGFP), beta-galactosidase (β-gal) or chloramphenicol acetyltransferase (CAT).

Expressed GHXTEN polypeptide product(s) may be purified via methods known in the art or by methods disclosed herein. Procedures such as gel filtration, affinity purification, salt fractionation, ion exchange chromatography, size exclusion chromatography, hydroxyapatite adsorption chromatography, hydrophobic interaction chromatography and gel electrophoresis may be used; each tailored to recover and purify the fusion protein produced by the respective host cells. Some expressed GHXTEN may require refolding during isolation and purification. Methods of purification are described in Robert K. Scopes, Protein Purification: Principles and Practice, Charles R. Castor (ed.), Springer-Verlag 1994, and Sambrook, et al., supra. Multi-step purification separations are also described in Baron, et al., Crit. Rev. Biotechnol. 10:179-90 (1990) and Below, et al., J. Chromatogr. A. 679:67-83 (1994).

VIII). Pharmaceutical Compositions

The present invention provides pharmaceutical compositions comprising GHXTEN. In one embodiment, the pharmaceutical composition comprises the GHXTEN fusion protein and at least one pharmaceutically acceptable carrier. GHXTEN polypeptides of the present invention can be formulated according to known methods to prepare pharmaceutically useful compositions, whereby the polypeptide is combined in admixture with a pharmaceutically acceptable carrier vehicle, such as aqueous solutions or buffers, pharmaceutically acceptable suspensions and emulsions. Examples of non-aqueous solvents include propyl ethylene glycol, polyethylene glycol and vegetable oils. Therapeutic formulations are prepared for storage by mixing the active ingredient having the desired degree of purity with optional physiologically acceptable carriers, excipients or stabilizers, as described in Remington's Pharmaceutical Sciences 16th edition, Osol, A. Ed. (1980), in the form of lyophilized formulations or aqueous solutions.

The pharmaceutical compositions can be administered orally, intranasally, parenterally or by inhalation therapy, and may take the form of tablets, lozenges, granules, capsules, pills, ampoules, suppositories or aerosol form. They may also take the form of suspensions, solutions and emulsions of the active ingredient in aqueous or nonaqueous diluents, syrups, granulates or powders. In addition, the pharmaceutical compositions can also contain other pharmaceutically active compounds or a plurality of compounds of the invention.

More particularly, the present pharmaceutical compositions may be administered for therapy by any suitable route including oral, rectal, nasal, topical (including transdermal, aerosol, buccal and sublingual), vaginal, parenteral (including subcutaneous, subcutaneous by infusion pump, intramuscular, intravenous and intradermal), intravitreal, and pulmonary. It will also be appreciated that the preferred route will vary with the condition and age of the recipient, and the disease being treated.

In one embodiment, the pharmaceutical composition is administered subcutaneously. In this embodiment, the composition may be supplied as a lyophilized powder to be reconstituted prior to administration. The composition may also be supplied in a liquid form, which can be administered directly to a patient. In one embodiment, the composition is supplied as a liquid in a pre-filled syringe such that a patient can easily self-administer the composition.

Extended release formulations useful in the present invention may be oral formulations comprising a matrix and a coating composition. Suitable matrix materials may include waxes (e.g., carnauba, bees wax, paraffin wax, ceresine, shellac wax, fatty acids, and fatty alcohols), oils, hardened oils or fats (e.g., hardened rapeseed oil, castor oil, beef tallow, palm oil, and soya bean oil), and polymers (e.g., hydroxypropyl cellulose, polyvinylpyrrolidone, hydroxypropyl methyl cellulose, and polyethylene glycol). Other suitable matrix tabletting materials are microcrystalline cellulose, powdered cellulose, hydroxypropyl cellulose, ethyl cellulose, with other carriers, and fillers. Tablets may also contain granulates, coated powders, or pellets. Tablets may also be multi-layered. Multi-layered tablets are especially preferred when the active ingredients have markedly different pharmacokinetic profiles. Optionally, the finished tablet may be coated or uncoated.

The coating composition may comprise an insoluble matrix polymer and/or a water soluble material. Water soluble materials can be polymers such as polyethylene glycol, hydroxypropyl cellulose, hydroxypropyl methyl cellulose, polyvinylpyrrolidone, polyvinyl alcohol, or monomeric materials such as sugars (e.g., lactose, sucrose, fructose, mannitol and the like), salts (e.g., sodium chloride, potassium chloride and the like), organic acids (e.g., fumaric acid, succinic acid, lactic acid, and tartaric acid), and mixtures thereof. Optionally, an enteric polymer may be incorporated into the coating composition. Suitable enteric polymers include hydroxypropyl methyl cellulose, acetate succinate, hydroxypropyl methyl cellulose, phthalate, polyvinyl acetate phthalate, cellulose acetate phthalate, cellulose acetate trimellitate, shellac, zein, and polymethacrylates containing carboxyl groups. The coating composition may be plasticised by adding suitable plasticisers such as, for example, diethyl phthalate, citrate esters, polyethylene glycol, glycerol, acetylated glycerides, acetylated citrate esters, dibutylsebacate, and castor oil. The coating composition may also include a filler, which can be an insoluble material such as silicon dioxide, titanium dioxide, talc, kaolin, alumina, starch, powdered cellulose, MCC, or polacrilin potassium. The coating composition may be applied as a solution or latex in organic solvents or aqueous solvents or mixtures thereof. Solvents such as water, lower alcohol, lower chlorinated hydrocarbons, ketones, or mixtures thereof may be used.

The compositions of the invention may be formulated using a variety of excipients. Suitable excipients include microcrystalline cellulose (e.g. Avicel PH102, Avicel PH101), polymethacrylate, poly(ethyl acrylate, methyl methacrylate, trimethylammonioethyl methacrylate chloride) (such as Eudragit RS-30D), hydroxypropyl methylcellulose (Methocel K100M, Premium CR Methocel K100M, Methocel E5, Opadry®), magnesium stearate, talc, triethyl citrate, aqueous ethylcellulose dispersion (Surelease®), and protamine sulfate. The slow release agent may also comprise a carrier, which can comprise, for example, solvents, dispersion media, coatings, antibacterial and antifungal agents, isotonic and absorption delaying agents. Pharmaceutically acceptable salts can also be used in these slow release agents, for example, mineral salts such as hydrochlorides, hydrobromides, phosphates, or sulfates, as well as the salts of organic acids such as acetates, propionates, malonates, or benzoates. The composition may also contain liquids, such as water, saline, glycerol, and ethanol, as well as substances such as wetting agents, emulsifying agents, or pH buffering agents. Liposomes may also be used as a carrier.

In another embodiment, the compositions of the present invention are encapsulated in liposomes, which have demonstrated utility in delivering beneficial active agents in a controlled manner over prolonged periods of time. Liposomes are closed bilayer membranes containing an entrapped aqueous volume. Liposomes may also be unilamellar vesicles possessing a single membrane bilayer or multilamellar vesicles with multiple membrane bilayers, each separated from the next by an aqueous layer. The structure of the resulting membrane bilayer is such that the hydrophobic (non-polar) tails of the lipid are oriented toward the center of the bilayer while the hydrophilic (polar) heads orient towards the aqueous phase. In one embodiment, the liposome may be coated with a flexible water soluble polymer that avoids uptake by the organs of the mononuclear phagocyte system, primarily the liver and spleen. Suitable hydrophilic polymers for surrounding the liposomes include, without limitation, PEG, polyvinylpyrrolidone, polyvinylmethylether, polymethyloxazoline, polyethyloxazoline, polyhydroxypropyloxazoline, polyhydroxypropylmethacrylamide, polymethacrylamide, polydimethylacrylamide, polyhydroxypropylmethacrylate, polyhydroxethylacrylate, hydroxymethylcellulose hydroxyethylcellulose, polyethyleneglycol, polyaspartamide and hydrophilic peptide sequences as described in U.S. Pat. Nos. 6,316,024; 6,126,966; 6,056,973; 6,043,094, the contents of which are incorporated by reference in their entirety.

Liposomes may be comprised of any lipid or lipid combination known in the art. For example, the vesicle-forming lipids may be naturally-occurring or synthetic lipids, including phospholipids, such as phosphatidylcholine, phosphatidylethanolamine, phosphatidic acid, phosphatidylserine, phasphatidylglycerol, phosphatidylinositol, and sphingomyelin as disclosed in U.S. Pat. Nos. 6,056,973 and 5,874,104. The vesicle-forming lipids may also be glycolipids, cerebrosides, or cationic lipids, such as 1,2-dioleyloxy-3-(trimethylamino) propane (DOTAP); N-[1-(2,3,-ditetradecyloxy) propyl-N,N-dimethyl-N-hydroxyethylammonium bromide (DMRIE); N-[1 [(2,3,-dioleyloxy)propyl]-N,N-dimethyl-N-hydroxy ethylammonium bromide (DORIE); N-[1-(2,3-dioleyloxy)propyl]-N,N,N-trimethylammonium chloride (DOTMA); 3 [N-(N',N'-dimethylaminoethane) carbamoly] cholesterol (DC-Chol); or dimethyldioctadecylammonium (DDAB) also as disclosed in U.S. Pat. No. 6,056,973. Cholesterol may also be present in the proper range to impart stability to the vesicle as disclosed in U.S. Pat. Nos. 5,916,588 and 5,874,104.

Additional liposomal technologies are described in U.S. Pat. Nos. 6,759,057; 6,406,713; 6,352,716; 6,316,024; 6,294,191; 6,126,966; 6,056,973; 6,043,094; 5,965,156; 5,916,588; 5,874,104; 5,215,680; and 4,684,479, the contents of which are incorporated herein by reference. These describe liposomes and lipid-coated microbubbles, and methods for their manufacture. Thus, one skilled in the art, considering both the disclosure of this invention and the disclosures of these other patents could produce a liposome for the extended release of the polypeptides of the present invention.

For liquid formulations, a desired property is that the formulation be supplied in a form that can pass through a 25, 28, 30, 31, 32 gauge needle for intravenous, intramuscular, intraarticular, or subcutaneous administration.

Administration via transdermal formulations can be performed using methods also known in the art, including those described generally in, e.g., U.S. Pat. Nos. 5,186,938 and 6,183,770, 4,861,800, 6,743,211, 6,945,952, 4,284,444, and WO 89/09051, incorporated herein by reference in their entireties. A transdermal patch is a particularly useful embodiment with polypeptides having absorption problems. Patches can be made to control the release of skin-permeable active ingredients over a 12 hour, 24 hour, 3 day, and 7 day period. In one example, a 2-fold daily excess of a polypeptide of the present invention is placed in a non-volatile fluid. The compositions of the invention are provided in the form of a viscous, non-volatile liquid. The penetration through skin of specific formulations may be measures by standard methods in the art (for example, Franz et al., J. Invest. Derm. 64:194-195 (1975)). Examples of suitable patches are passive transfer skin patches, iontophoretic skin patches, or patches with microneedles such as Nicoderm.

In other embodiments, the composition may be delivered via intranasal, buccal, or sublingual routes to the brain to enable transfer of the active agents through the olfactory passages into the CNS and reducing the systemic administration. Devices commonly used for this route of administration are included in U.S. Pat. No. 6,715,485. Compositions delivered via this route may enable increased CNS dosing or reduced total body burden reducing systemic toxicity risks associated with certain drugs. Preparation of a pharmaceutical composition for delivery in a subdermally implantable device can be performed using methods known in the art, such as those described in, e.g., U.S. Pat. Nos. 3,992,518; 5,660,848; and 5,756,115.

Osmotic pumps may be used as slow release agents in the form of tablets, pills, capsules or implantable devices. Osmotic pumps are well known in the art and readily available to one of ordinary skill in the art from companies experienced in providing osmotic pumps for extended release drug delivery. Examples are ALZA's DUROS™; ALZA's OROS™; Osmotica Pharmaceutical's Osmodex™ system; Shire Laboratories' EnSoTrol™ system; and Alzet™. Patents that describe osmotic pump technology are U.S. Pat. Nos. 6,890,918; 6,838,093; 6,814,979; 6,713,086; 6,534,090; 6,514,532; 6,361,796; 6,352,721; 6,294,201; 6,284,276; 6,110,498; 5,573,776; 4,200,0984; and 4,088,864, the contents of which are incorporated herein by reference. One skilled in the art, considering both the disclosure of this invention and the disclosures of these other patents could produce an osmotic pump for the extended release of the polypeptides of the present invention.

Syringe pumps may also be used as slow release agents. Such devices are described in U.S. Pat. Nos. 4,976,696; 4,933,185; 5,017,378; 6,309,370; 6,254,573; 4,435,173; 4,398,908; 6,572,585; 5,298,022; 5,176,502; 5,492,534; 5,318,540; and 4,988,337, the contents of which are incorporated herein by reference. One skilled in the art, considering both the disclosure of this invention and the disclosures of these other patents could produce a syringe pump for the extended release of the compositions of the present invention. A.

IX). Pharmaceutical Kits

In another aspect, the invention provides a kit to facilitate the use of the GHXTEN polypeptides. The kit comprises the pharmaceutical composition provided herein, a label identifying the pharmaceutical composition, and an instruction for storage, reconstitution and/or administration of the pharmaceutical compositions to a subject. In some embodiment, the kit comprises, preferably: (a) an amount of a GHXTEN fusion protein composition sufficient to treat a disease, condition or disorder upon administration to a subject in need thereof; and (b) an amount of a pharmaceutically acceptable carrier; together in a formulation ready for injection or for reconstitution with sterile water, buffer, or dextrose; together with a label identifying the GHXTEN drug and storage and handling conditions, and a sheet of the approved indications for the drug, instructions for the reconstitution and/or administration of the GHXTEN drug for the use for the prevention and/or treatment of a approved indication, appropriate dosage and safety information, and information identifying the lot and expiration of the drug. In another embodiment of the foregoing, the kit can comprise a second container that can carry a suitable diluent for the GHXTEN composition, which will provide the user with the appropriate concentration of GHXTEN to be delivered to the subject.

EXAMPLES

Example 1: Construction of XTEN_AD36 Motif Segments

The following example describes the construction of a collection of codon-optimized genes encoding motif sequences of 36 amino acids. As a first step, a stuffer vector pCW0359 was constructed based on a pET vector and that includes a T7 promoter. pCW0359 encodes a cellulose binding domain (CBD) and a TEV protease recognition site followed by a stuffer sequence that is flanked by BsaI, BbsI, and KpnI sites. The BsaI and BbsI sites were inserted such that they generate compatible overhangs after digestion. The stuffer sequence is followed by a truncated version of the GFP gene and a His tag. The stuffer sequence contains stop codons and thus E. coli cells carrying the stuffer plasmid pCW0359 form non-fluorescent colonies. The stuffer vector pCW0359 was digested with BsaI and KpnI to remove the stuffer segment and the resulting vector fragment was isolated by agarose gel purification. The sequences were designated XTEN_AD36, reflecting the AD family of motifs. Its segments have the amino acid sequence [X]$_3$ where X is a 12mer peptide with the sequences: GESPGGSSGSES (SEQ ID NO: 136), GSEGSSGPGESS (SEQ ID NO: 137), GSSESGSSEGGP (SEQ ID NO: 138), or GSGGEPSESGSS (SEQ ID NO: 139). The insert was obtained by annealing the following pairs of phosphorylated synthetic oligonucleotide pairs:

```
                                      (SEQ ID NO: 140)
AD1for: AGGTGAATCTCCDGGTGGYTCYAGCGGTTCYGARTC (SEQ ID NO: 141)
AD1rev: ACCTGAYTCRGAACCGCTRGARCCACCHGGAGATTC (SEQ ID NO: 142)
AD2for: AGGTAGCGAAGGTTCTTCYGGTCCDGGYGARTCYTC (SEQ ID NO: 143)
AD2rev: ACCTGARGAYTCRCCHGGACCRGAAGAACCTTCGCT (SEQ ID NO: 144)
AD3for: AGGTTCYTCYGAAAGCGGTTCTTCYGARGGYGGTCC (SEQ ID NO: 145)
AD3rev: ACCTGGACCRCCYTCRGAAGAACCGCTTTCRGARGA (SEQ ID NO: 146)
AD4for: AGGTTCYGGTGGYGAACCDTCYGARTCTGGTAGCTC
```

We also annealed the phosphorylated oligonucleotide 3KpnIstopperFor: AGGTTCGTCTTCACTCGAGGGTAC (SEQ ID NO: 147) and the non-phosphorylated oligonucleotide pr_3KpnIstopperRev: CCTCGAGTGAAGACGA (SEQ ID NO: 148). The annealed oligonucleotide pairs were ligated, which resulted in a mixture of products with varying length that represents the varying number of 12mer repeats ligated to one BbsI/KpnI segment. The products corresponding to the length of 36 amino acids were isolated from the mixture by preparative agarose gel electrophoresis and ligated into the BsaI/KpnI digested stuffer vector pCW0359. Most of the clones in the resulting library designated LCW0401 showed green fluorescence after induction, which shows that the sequence of XTEN_AD36 had been ligated in frame with the GFP gene and that most sequences of XTEN_AD36 had good expression levels.

We screened 96 isolates from library LCW0401 for high level of fluorescence by stamping them onto agar plate containing IPTG. The same isolates were evaluated by PCR and 48 isolates were identified that contained segments with 36 amino acids as well as strong fluorescence. These isolates were sequenced and 39 clones were identified that contained correct XTEN_AD36 segments. The file names of the nucleotide and amino acid constructs for these segments are listed in Table 8.

TABLE 8

DNA and Amino Acid Sequences for 36-mer motifs

| File name | Amino acid sequence | SEQ ID NO: | Nucleotide sequence | SEQ ID NO: |
|---|---|---|---|---|
| LCW0401_001_GFP-N_A01.ab1 | GSGGEPSESGSSGESPGG SSGSESGESPGGSSGSES | 149 | GGTTCTGGTGGCGAACCGTCCGAGTCTGGTAGC TCAGGTGAATCTCCGGGTGGCTCTAGCGGTTCC GAGTCAGGTGAATCTCCTGGTGGTTCCAGCGGT TCCGAGTCA | 150 |
| LCW0401_002_GFP-N_B01.ab1 | GSEGSSGPGESSGESPGG SSGSESGSSESGSSEGGP | 151 | GGTAGCGAAGGTTCTTCTGGTCCTGGCGAGTCT TCAGGTGAATCTCCTGGTGGTTCCAGCGGTTCT GAATCAGGTTCCTCCGAAAGCGGTTCTTCCGAG GGCGGTCCA | 152 |
| LCW0401_003_GFP-N_C01.ab1 | GSSESGSSEGGPGSSESG SSEGGPGESPGGSSGSES | 153 | GGTTCCTCTGAAAGCGGTTCTTCCGAAGGTGGT CCAGGTTCCTCTGAAAGCGGTTCTTCTGAGGGT GGTCCAGGTGAATCTCCGGGTGGCTCCAGCGGT TCCGAGTCA | 154 |
| LCW0401_004_GFP-N_D01.ab1 | GSGGEPSESGSSGSSESG SSEGGPGSGGEPSESGSS | 155 | GGTTCCGGTGGCGAACCGTCTGAATCTGGTAGC TCAGGTTCTTCTGAAAGCGGTTCTTCCGAGGGT GGTCCAGGTTCTGGTGGTGAACCTTCCGAGTCT GGTAGCTCA | 156 |
| LCW0401_007_GFP-N_F01.ab1 | GSSESGSSEGGPGSEGSS GPGESSGSEGSSGPGESS | 157 | GGTTCTTCCGAAAGCGGTTCTTCTGAGGGTGGT CCAGGTAGCGAAGGTTCTTCCGGTCCAGGTGAG TCTTCAGGTAGCGAAGGTTCTTCTGGTCCTGGT GAATCTTCA | 158 |
| LCW0401_008_GFP-N_G01.ab1 | GSSESGSSEGGPGESPGG SSGSESGSEGSSGPGESS | 159 | GGTTCCTCTGAAAGCGGTTCTTCCGAGGGTGGT CCAGGTGAATCTCCAGGTGGTTCCAGCGGTTCT GAGTCAGGTAGCGAAGGTTCTTCTGGTCCAGGT GAATCCTCA | 160 |
| LCW0401_012_GFP-N_H01.ab1 | GSGGEPSESGSSGSGGEP SESGSSGSEGSSGPGESS | 161 | GGTTCTGGTGGTGAACCGTCTGAGTCTGGTAGC TCAGGTTCCGGTGGCGAACCATCCGAATCTGGT AGCTCAGGTAGCGAAGGTTCTTCCGGTCCAGGT GAGTCTTCA | 162 |
| LCW0401_015_GFP-N_A02.ab1 | GSSESGSSEGGPGSEGSS GPGESSGESPGGSSGSES | 163 | GGTTCTTCCGAAAGCGGTTCTTCCGAAGGCGGT CCAGGTAGCGAAGGTTCTTCTGGTCCAGGCGAA TCTTCAGGTGAATCTCCTGGTGGCTCCAGCGGT TCTGAGTCA | 164 |

TABLE 8-continued

DNA and Amino Acid Sequences for 36-mer motifs

| File name | Amino acid sequence | SEQ ID NO: | Nucleotide sequence | SEQ ID NO: |
|---|---|---|---|---|
| LCW0401_016_GFP-N_B02.ab1 | GSSESGSSEGGPGSSESGSSEGGPGSSESGSSEGGP | 165 | GGTTCCTCCGAAAGCGGTTCTTCTGAGGGCGGTCCAGGTTCCTCCGAAAGCGGTTCTTCCGAGGGCGGTCCAGGTTCTTCTGAAAGCGGTTCTTCCGAGGGCGGTCCA | 166 |
| LCW0401_020_GFP-N_E02.ab1 | GSGGEPSESGSSGSEGSSGPGESSGSSESGSSEGGP | 167 | GGTTCCGGTGGCGAACCGTCCGAATCTGGTAGCTCAGGTAGCGAAGGTTCTTCTGGTCCAGGCGAATCTTCAGGTTCCTCTGAAAGCGGTTCTTCTGAGGGCGGTCCA | 168 |
| LCW0401_022_GFP-N_F02.ab1 | GSGGEPSESGSSGSSESGSSEGGPGSGGEPSESGSS | 169 | GGTTCTGGTGGTGAACCGTCCGAATCTGGTAGCTCAGGTTCTTCCGAAAGCGGTTCTTCTGAAGGTGGTCCAGGTTCTTCCGGTGGCGAACCTTCTGAATCTGGTAGCTCA | 170 |
| LCW0401_024_GFP-N_G02.ab1 | GSGGEPSESGSSGSSESGSSEGGPGESPGGSSGSES | 171 | GGTTCTGGTGGCGAACCGTCCGAATCTGGTAGCTCAGGTTCCTCCGAAAGCGGTTCTTCTGAAGGTGGTCCAGGTGAATCTCCAGGTGGTTCTAGCGGTTCTGAATCA | 172 |
| LCW0401_026_GFP-N_H02.ab1 | GSGGEPSESGSSGSESPGGSSGSESGSEGSSGPGESS | 173 | GGTTCTGGTGGCGAACCGTCTGAGTCTGGTAGCTCAGGTGAATCTCCTGGTGGCTCCAGCGGTTCTGAATCAGGTAGCGAAGGTTCTTCTGGTCCTGGTGAATCTTCA | 174 |
| LCW0401_027_GFP-N_A03.ab1 | GSGGEPSESGSSGSESPGGSSGSESGSGGEPSESGSS | 175 | GGTTCCGGTGGCGAACCTTCCGAATCTGGTAGCTCAGGTGAATCTCCGGGTGGTTCTAGCGGTTCTGAGTCAGGTTCTGGTGGTGAACCTTCCGAGTCTGGTAGCTCA | 176 |
| LCW0401_028_GFP-N_B03.ab1 | GSSESGSSEGGPGSSESGSSEGGPGSSESGSSEGGP | 177 | GGTTCCTCTGAAAGCGGTTCTTCTGAGGGCGGTCCAGGTTCTTCCGAAAGCGGTTCTTCCGAGGGCGGTCCAGGTTCTTCCGAAAGCGGTTCTTCTGAAGGCGGTCCA | 178 |
| LCW0401_030_GFP-N_C03.ab1 | GESPGGSSGSESGSEGSSGPGESSGSEGSSGPGESS | 179 | GGTGAATCTCCGGGTGGCTCCAGCGGTTCTGAGTCAGGTAGCGAAGGTTCTTCCGGTCCGGGTGAGTCCTCAGGTAGCGAAGGTTCTTCCGGTCCTGGTGAGTCTTCA | 180 |
| LCW0401_031_GFP-N_D03.ab1 | GSGGEPSESGSSGSGGEPSESGSSGSSESGSSEGGP | 181 | GGTTCTGGTGGCGAACCTTCCGAATCTGGTAGCTCAGGTTCCGGTGGTGAACCTTCTGAATCTGGTAGCTCAGGTTCTTCTGAAAGCGGTTCTTCCGAGGGCGGTCCA | 182 |
| LCW0401_033_GFP-N_E03.ab1 | GSGGEPSESGSSGSGGEPSESGSSGSGGEPSESGSS | 183 | GGTTCCGGTGGTGAACCTTCTGAATCTGGTAGCTCAGGTTCCGGTGGCGAACCATCCGAGTCTGGTAGCTCAGGTTCCGGTGGTGAACCATCCGAGTCTGGTAGCTCA | 184 |
| LCW0401_037_GFP-N_F03.ab1 | GSGGEPSESGSSGSSESGSSEGGPGSEGSSGPGESS | 185 | GGTTCCGGTGGCGAACCTTCTGAATCTGGTAGCTCAGGTTCCTCCGAAAGCGGTTCTTCTGAGGGCGGTCCAGGTAGCGAAGGTTCTTCTGGTCCGGGCGAGTCTTCA | 186 |
| LCW0401_038_GFP-N_G03.ab1 | GSGGEPSESGSSGSEGSSGPGESSGSGGEPSESGSS | 187 | GGTTCCGGTGGTGAACCGTCCGAGTCTGGTAGCTCAGGTAGCGAAGGTTCTTCTGGTCCGGGTGAGTCTTCAGGTTCTGGTGGCGAACCGTCCGAATCTGGTAGCTCA | 188 |
| LCW0401_039_GFP-N_H03.ab1 | GSGGEPSESGSSGSESPGGSSGSESGSGGEPSESGSS | 189 | GGTTCTGGTGGCGAACCGTCCGAATCTGGTAGCTCAGGTGAATCTCCTGGTGGTTCCAGCGGTTCCGAGTCAGGTTCTGGTGGCGAACCTTCCGAATCTGGTAGCTCA | 190 |
| LCW0401_040_GFP-N_A04.ab1 | GSSESGSSEGGPGSGGEPSESGSSGSSESGSSEGGP | 191 | GGTTCTTCCGAAAGCGGTTCTTCCGAGGGCGGTCCAGGTTCCGGTGGTGAACCATCTGAATCTGGTAGCTCAGGTTCTTCTGAAAGCGGTTCTTCTGAAGGTGGTCCA | 192 |
| LCW0401_042_GFP-N_C04.ab1 | GSEGSSGPGESSGESPGGSSGSESGSEGSSGPGESS | 193 | GGTAGCGAAGGTTCTTCCGGTCCTGGTGAGTCTTCAGGTGAATCTCCAGGTGGCTCTAGCGGTTCCGAGTCAGGTAGCGAAGGTTCTTCTGGTCCTGGCGAGTCCTCA | 194 |

TABLE 8-continued

DNA and Amino Acid Sequences for 36-mer motifs

| File name | Amino acid sequence | SEQ ID NO: | Nucleotide sequence | SEQ ID NO: |
| --- | --- | --- | --- | --- |
| LCW0401_046_GFP-N_D04.ab1 | GSSESGSSEGGPGSSESG SSEGGPGSSESGSSEGGP | 195 | GGTTCCTCTGAAAGCGGTTCTTCCGAAGGCGGT CCAGGTTCTTCCGAAAGCGGTTCTTCTGAGGGC GGTCCAGGTTCCTCCGAAAGCGGTTCTTCTGAG GGTGGTCCA | 196 |
| LCW0401_047_GFP-N_E04.ab1 | GSGGEPSESGSSGESPGG SSGSESGESPGGSSGSES | 197 | GGTTCTGGTGGCGAACCTTCCGAGTCTGGTAGC TCAGGTGAATCTCCGGGTGGTTCTAGCGGTTCC GAGTCAGGTGAATCTCCGGGTGGTTCCAGCGGT TCTGAGTCA | 198 |
| LCW0401_051_GFP-N_F04.ab1 | GSGGEPSESGSSGSEGSS GPGESSGESPGGSSGSES | 199 | GGTTCTGGTGGCGAACCATCTGAGTCTGGTAGC TCAGGTAGCGAAGGTTCTTCCGGTCCAGGCGAG TCTTCAGGTGAATCTCCTGGTGGCTCCAGCGGT TCTGAGTCA | 200 |
| LCW0401_053_GFP-N_H04.ab1 | GESPGGSSGSESGESPGG SSGSESGESPGGSSGSES | 201 | GGTGAATCTCCTGGTGGTTCCAGCGGTTCCGAG TCAGGTGAATCTCCAGGTGGCTCTAGCGGTTCC GAGTCAGGTGAATCTCCTGGTGGTTCTAGCGGT TCTGAATCA | 202 |
| LCW0401_054_GFP-N_A05.ab1 | GSEGSSGPGESSGSEGSS GPGESSGSGGEPSESGSS | 203 | GGTAGCGAAGGTTCTTCCGGTCCAGGTGAATCT TCAGGTAGCGAAGGTTCTTCTGGTCCTGGTGAA TCCTCAGGTTCCGGTGGCGAACCATCTGAATCT GGTAGCTCA | 204 |
| LCW0401_059_GFP-N_D05.ab1 | GSGGEPSESGSSGSEGSS GPGESSGESPGGSSGSES | 205 | GGTTCTGGTGGCGAACCATCCGAATCTGGTAGC TCAGGTAGCGAAGGTTCTTCTGGTCCTGGCGAA TCTTCAGGTGAATCTCCAGGTGGCTCTAGCGGT TCCGAATCA | 206 |
| LCW0401_060_GFP-N_E05.ab1 | GSGGEPSESGSSGSSESG SSEGGPGSGGEPSESGSS | 207 | GGTTCCGGTGGTGAACCGTCCGAATCTGGTAGC TCAGGTTCCTCTGAAAGCGGTTCTTCCGAGGGT GGTCCAGGTTCCGGTGGTGAACCTTCTGAGTCT GGTAGCTCA | 208 |
| LCW0401_061_GFP-N_F05.ab1 | GSSESGSSEGGPGSGGEP SESGSSGSEGSSGPGESS | 209 | GGTTCCTCTGAAAGCGGTTCTTCTGAGGGCGGT CCAGGTTCTGGTGGCGAACCATCTGAATCTGGT AGCTCAGGTAGCGAAGGTTCTTCCGGTCCGGGT GAATCTTCA | 210 |
| LCW0401_063_GFP-N_H05.ab1 | GSGGEPSESGSSGSEGSS GPGESSGSEGSSGPGESS | 211 | GGTTCTGGTGGTGAACCGTCCGAATCTGGTAGC TCAGGTAGCGAAGGTTCTTCTGGTCCTGGCGAG TCTTCAGGTAGCGAAGGTTCTTCTGGTCCTGGT GAATCTTCA | 212 |
| LCW0401_066_GFP-N_B06.ab1 | GSGGEPSESGSSGSSESG SSEGGPGSGGEPSESGSS | 213 | GGTTCTGGTGGCGAACCATCCGAGTCTGGTAGC TCAGGTTCTTCCGAAAGCGGTTCTTCCGAAGGC GGTCCAGGTTCTGGTGGTGAACCGTCCGAATCT GGTAGCTCA | 214 |
| LCW0401_067_GFP-N_C06.ab1 | GSGGEPSESGSSGESPGG SSGSESGESPGGSSGSES | 215 | GGTTCCGGTGGCGAACCTTCCGAATCTGGTAGC TCAGGTGAATCTCCGGGTGGTTCTAGCGGTTCC GAATCAGGTGAATCTCCAGGTGGTTCTAGCGGT TCCGAATCA | 216 |
| LCW0401_069_GFP-N_D06.ab1 | GSGGEPSESGSSGSGGEP SESGSSGESPGGSSGSES | 217 | GGTTCCGGTGGTGAACCATCTGAGTCTGGTAGC TCAGGTTCCGGTGGCGAACCGTCCGAGTCTGGT AGCTCAGGTGAATCTCCGGGTGGTTCCAGCGGT TCCGAATCA | 218 |
| LCW0401_070_GFP-N_E06.ab1 | GSEGSSGPGESSGSSESG SSEGGPGSEGSSGPGESS | 219 | GGTAGCGAAGGTTCTTCTGGTCCGGGCGAATCC TCAGGTTCCTCCGAAAGCGGTTCTTCCGAAGGT GGTCCAGGTAGCGAAGGTTCTTCCGGTCCTGGT GAATCTTCA | 220 |
| LCW0401_078_GFP-N_F06.ab1 | GSSESGSSEGGPGESPGG SSGSESGESPGGSSGSES | 221 | GGTTCCTCTGAAAGCGGTTCTTCTGAAGGCGGT CCAGGTGAATCTCCGGGTGGCTCCAGCGGTTCT GAATCAGGTGAATCTCCTGGTGGCTCCAGCGGT TCCGAGTCA | 222 |
| LCW0401_079_GFP-N_G06.ab1 | GSEGSSGPGESSGSEGSS GPGESSGSGGEPSESGSS | 223 | GGTAGCGAAGGTTCTTCTGGTCCAGGCGAGTCT TCAGGTAGCGAAGGTTCTTCCGGTCCTGGCGAG TCTTCAGGTTCCGGTGGCGAACCGTCCGAATCT GGTAGCTCA | 224 |

Example 2: Construction of XTEN_AE36 Segments

A codon library encoding XTEN sequences of 36 amino acid length was constructed. The XTEN sequence was designated XTEN_AE36. Its segments have the amino acid sequence [X]₃ where X is a 12mer peptide with the sequence: GSPAGSPTSTEE (SEQ ID NO: 225), GSEPATSGSE TP (SEQ ID NO: 226), GTSESA TPESGP (SEQ ID NO: 227), or GTSTEPSEGSAP (SEQ ID NO: 228). The insert was obtained by annealing the following pairs of phosphorylated synthetic oligonucleotide pairs:

```
                                        (SEQ ID NO: 229)
AE1for:  AGGTAGCCCDGCWGGYTCTCCDACYTCYACYGARGA (SEQ ID NO: 230)
AE1rev:  ACCTTCYTCRGTRGARGTHGGAGARCCWGCHGGGCT (SEQ ID NO: 231)
AE2for:  AGGTAGCGAACCKGCWACYTCYGGYTCTGARACYCC (SEQ ID NO: 232)
AE2rev:  ACCTGGRGTYTCAGARCCRGARGTWGCMGGTTCGCT (SEQ ID NO: 233)
AE3for:  AGGTACYTCTGAAAGCGCWACYCCKGARTCYGGYCC (SEQ ID NO: 234)
AE3rev:  ACCTGGRCCRGAYTCMGGRGTWGCGCTTTCAGARGT (SEQ ID NO: 235)
AE4for:  AGGTACYTCTACYGAACCKTCYGARGGYAGCGCWCC (SEQ ID NO: 236)
AE4rev:  ACCTGGWGCGCTRCCYTCRGAMGGTTCRGTAGARGT
```

We also annealed the phosphorylated oligonucleotide 3KpnIstopperFor: AGGTTCGTCTTCACTCGAGGGTAC (SEQ ID NO: 237) and the non-phosphorylated oligonucleotide pr_3KpnIstopperRev: CCTCGAGTGAAGACGA (SEQ ID NO: 238). The annealed oligonucleotide pairs were ligated, which resulted in a mixture of products with varying length that represents the varying number of 12mer repeats ligated to one BbsI/KpnI segment. The products corresponding to the length of 36 amino acids were isolated from the mixture by preparative agarose gel electrophoresis and ligated into the BsaI/KpnI digested stuffer vector pCW0359. Most of the clones in the resulting library designated LCW0402 showed green fluorescence after induction which shows that the sequence of XTEN_AE36 had been ligated in frame with the GFP gene and most sequences of XTEN_AE36 show good expression.

We screened 96 isolates from library LCW0402 for high level of fluorescence by stamping them onto agar plate containing IPTG. The same isolates were evaluated by PCR and 48 isolates were identified that contained segments with 36 amino acids as well as strong fluorescence. These isolates were sequenced and 37 clones were identified that contained correct XTEN_AE36 segments. The file names of the nucleotide and amino acid constructs for these segments are listed in Table 9.

TABLE 9

DNA and Amino Acid Sequences for 36-mer motifs

| File name | Amino acid sequence | SEQ ID NO: | Nucleotide sequence | SEQ ID NO: |
|---|---|---|---|---|
| LCW0402_002_GFP-N_A07.ab1 | GSPAGSPTSTEEGTSE SATPESGPGTSTEPSE GSAP | 239 | GGTAGCCCGGCAGGCTCTCCGACCTCTACTGAGGAA GGTACTTCTGAAAGCGCAACCCCGGAGTCCGGCCCA GGTACCTCTACCGAACCGTCTGAGGGCAGCGCACCA | 240 |
| LCW0402_003_GFP-N_B07.ab1 | GTSTEPSEGSAPGTST EPSEGSAPGTSTEPSE GSAP | 241 | GGTACTTCTACCGAACCGTCCGAAGGCAGCGCTCCA GGTACCTCTACTGAACCTTCCGAGGGCAGCGCTCCA GGTACCTCTACCGAACCTTCTGAAGGTAGCGCACCA | 242 |
| LCW0402_004_GFP-N_C07.ab1 | GTSTEPSEGSAPGTSE SATPESGPGTSESATP ESGP | 243 | GGTACCTCTACCGAACCGTCTGAAGGTAGCGCACCA GGTACCTCTGAAAGCGCAACTCCTGAGTCCGGTCCA GGTACTTCTGAAAGCGCAACCCCGGAGTCTGGCCCA | 244 |
| LCW0402_005_GFP-N_D07.ab1 | GTSTEPSEGSAPGTSE SATPESGPGTSESATP ESGP | 245 | GGTACTTCTACTGAACCGTCTGAAGGTAGCGCACCA GGTACTTCTGAAAGCGCAACCCCGGAATCCGGCCCA GGTACCTCTGAAAGCGCAACCCCGGAGTCCGGCCCA | 246 |
| LCW0402_006_GFP-N_E07.ab1 | GSEPATSGSETPGTSE SATPESGPGSPAGSPT STEE | 247 | GGTAGCGAACCGGCAACCTCCGGCTCTGAAACCCCA GGTACCTCTGAAAGCGCTACTCCTGAATCCGGCCCA GGTAGCCCGGCAGGTTCTCCGACTTCCACTGAGGAA | 248 |
| LCW0402_008_GFP-N_F07.ab1 | GTSESATPESGPGSEP ATSGSETPGTSTEPSE GSAP | 249 | GGTACTTCTGAAAGCGCAACCCCTGAATCCGGTCCA GGTAGCGAACCGGCTACTTCTGGCTCTGAGACTCCA GGTACTTCTACCGAACCGTCCGAAGGTAGCGCACCA | 250 |
| LCW0402_009_GFP-N_G07.ab1 | GSPAGSPTSTEEGSPA GSPTSTEEGSEPATSG SETP | 251 | GGTAGCCCGGCTGGCTCTCCAACCTCCACTGAGGAA GGTAGCCCGGCTGGCTCTCCAACCTCCACTGAAGAA GGTAGCGAACCGGCTACCTCCGGCTCTGAAACTCCA | 252 |
| LCW0402_011_GFP-N_A08.ab1 | GSPAGSPTSTEEGTSE SATPESGPGTSTEPSE GSAP | 253 | GGTAGCCCGGCTGGCTCTCCTACCTCTACTGAGGAA GGTACTTCTGAAAGCGCTACTCCTGAGTCTGGTCCA GGTACCTCTACTGAACCGTCCGAAGGTAGCGCTCCA | 254 |
| LCW0402_012_GFP-N_B08.ab1 | GSPAGSPTSTEEGSPA GSPTSTEEGTSTEPSE GSAP | 255 | GGTAGCCCTGCTGGCTCTCCGACTTCTACTGAGGAA GGTAGCCCGGCTGGTTCTCCGACTTCTACTGAGGAA GGTACTTCTACCGAACCTTCCGAAGGCAGCGCTCCA | 256 |

TABLE 9-continued

DNA and Amino Acid Sequences for 36-mer motifs

| File name | Amino acid sequence | SEQ ID NO: | Nucleotide sequence | SEQ ID NO: |
|---|---|---|---|---|
| LCW0402_013_GFP-N_C08.ab1 | GTSESATPESGPGTST EPSEGSAPGTSTEPSE GSAP | 257 | GGTACTTCTGAAAGCGCTACTCCGGAGTCCGGTCCA GGTACCTCTACCGAACCGTCCGAAGGCAGCGCTCCA GGTACTTCTACTGAACCTTCTGAGGGTAGCGCTCCA | 258 |
| LCW0402_014_GFP-N_D08.ab1 | GTSTEPSEGSAPGSPA GSPTSTEEGTSTEPSE GSAP | 259 | GGTACCTCTACCGAACCTTCCGAAGGTAGCGCTCCA GGTAGCCCGGCAGGTTCTCCTACTTCCACTGAGGAA GGTACTTCTACCGAACCTTCTGAGGGTAGCGCACCA | 260 |
| LCW0402_015_GFP-N_E08.ab1 | GSEPATSGSETPGSPA GSPTSTEEGTSESATP ESGP | 261 | GGTAGCGAACCGGCTACTTCCGGCTCTGAGACTCCA GGTAGCCCTGCTGGCTCTCCGACCTCTACCGAAGAA GGTACCTCTGAAAGCGCTACCCCTGAGTCTGGCCCA | 262 |
| LCW0402_016_GFP-N_F08.ab1 | GTSTEPSEGSAPGTSE SATPESGPGTSESATP ESGP | 263 | GGTACTTCTACCGAACCTTCCGAGGGCAGCGCACCA GGTACTTCTGAAAGCGCTACCCCTGAGTCCGGCCCA GGTACTTCTGAAAGCGCTACTCCTGAATCCGGTCCA | 264 |
| LCW0402_020_GFP-N_G08.ab1 | GTSTEPSEGSAPGSEP ATSGSETPGSPAGSPT STEE | 265 | GGTACTTCTACTGAACCGTCTGAAGGCAGCGCACCA GGTAGCGAACCGGCTACTTCCGGTTCTGAAACCCCA GGTAGCCCAGCAGGTTCTCCAACTTCTACTGAAGAA | 266 |
| LCW0402_023_GFP-N_A09.ab1 | GSPAGSPTSTEEGTSE SATPESGPGSEPATSG SETP | 267 | GGTAGCCCTGCTGGCTCTCCAACCTCCACCGAAGAA GGTACCTCTGAAAGCGCAACCCCTGAATCCGGCCCA GGTAGCGAACCGGCAACCTCCGGTTCTGAAACCCCA | 268 |
| LCW0402_024_GFP-N_B09.ab1 | GTSESATPESGPGSPA GSPTSTEEGSPAGSPT STEE | 269 | GGTACTTCTGAAAGCGCTACTCCTGAGTCCGGCCCA GGTAGCCCGGCTGGCTCTCCGACTTCCACCGAGGAA GGTAGCCCGGCTGGCTCTCCAACTTCTACTGAAGAA | 270 |
| LCW0402_025_GFP-N_C09.ab1 | GTSTEPSEGSAPGTSE SATPESGPGTSTEPSE GSAP | 271 | GGTACCTCTACTGAACCTTCTGAGGGCAGCGCTCCA GGTACTTCTGAAAGCGCTACCCCGGAGTCCGGTCCA GGTACTTCTACTGAACCGTCCGAAGGTAGCGCACCA | 272 |
| LCW0402_026_GFP-N_D09.ab1 | GSPAGSPTSTEEGTST EPSEGSAPGSEPATSG SETP | 273 | GGTAGCCCGGCAGGCTCTCCGACTTCCACCGAGGAA GGTACCTCTACTGAACCTTCTGAGGGTAGCGCTCCA GGTAGCGAACCGGCAACCCTCTGGCTCTGAAACCCCA | 274 |
| LCW0402_027_GFP-N_E09.ab1 | GSPAGSPTSTEEGTST EPSEGSAPGTSTEPSE GSAP | 275 | GGTAGCCCAGCAGGCTCTCCGACTTCCACTGAGGAA GGTACTTCTACTGAACCTTCCGAAGGCAGCGCACCA GGTACCTCTACTGAACCTTCTGAGGGCAGCGCTCCA | 276 |
| LCW0402_032_GFP-N_H09.ab1 | GSEPATSGSETPGTSE SATPESGPGSPAGSPT STEE | 277 | GGTAGCGAACCTGCTACCTCCGGTTCTGAAACCCCA GGTACCTCTGAAAGCGCAACTCCGGAGTCTGGTCCA GGTAGCCCTGCAGGTTCTCCTACCTCCACTGAGGAA | 278 |
| LCW0402_034_GFP-N_A10.ab1 | GTSESATPESGPGTST EPSEGSAPGTSTEPSE GSAP | 279 | GGTACCTCTGAAAGCGCTACTCCGGAGTCTGGCCCA GGTACCTCTACTGAACCGTCTGAGGGTAGCGCTCCA GGTACTTCTACTGAACCGTCCGAAGGTAGCGCACCA | 280 |
| LCW0402_036_GFP-N_C10.ab1 | GSPAGSPTSTEEGTST EPSEGSAPGTSTEPSE GSAP | 281 | GGTAGCCCGGCTGGTTCTCCGACTTCCACCGAGGAA GGTACCTCTACTGAACCTTCTGAGGGTAGCGCTCCA GGTACCTCTACTGAACCTTCCGAAGGCAGCGCTCCA | 282 |
| LCW0402_039_GFP-N_E10.ab1 | GTSTEPSEGSAPGTST EPSEGSAPGTSTEPSE GSAP | 283 | GGTACTTCTACCGAACCGTCCGAGGGCAGCGCTCCA GGTACTTCTACTGAACCTTCTGAAGGCAGCGCTCCA GGTACTTCTACTGAACCTTCCGAAGGTAGCGCACCA | 284 |
| LCW0402_040_GFP-N_F10.ab1 | GSEPATSGSETPGTSE SATPESGPGTSTEPSE GSAP | 285 | GGTAGCGAACCTGCAACCTCTGGCTCTGAAACCCCA GGTACCTCTGAAAGCGCTACTCCTGAATCTGGCCCA GGTACTTCTACTGAACCGTCCGAGGGCAGCGCACCA | 286 |
| LCW0402_041_GFP-N_G10.ab1 | GTSTEPSEGSAPGSPA GSPTSTEEGTSTEPSE GSAP | 287 | GGTACTTCTACCGAACCGTCCGAGGGTAGCGCACCA GGTAGCCCAGCAGGTTCTCCTACCTCCACCGAAGAA GGTACTTCTACCGAACCGTCCGAGGGTAGCGCACCA | 288 |
| LCW0402_050_GFP-N_A11.ab1 | GSEPATSGSETPGTSE SATPESGPGSEPATSG SETP | 289 | GGTAGCGAACCGGCAACCTCCGGCTCTGAAACTCCA GGTACTTCTGAAAGCGCTACTCCGGAATCCGGCCCA GGTAGCGAACCGGCTACTTCCGGCTCTGAAACCCCA | 290 |
| LCW0402_051_GFP-N_B11.ab1 | GSEPATSGSETPGTSE SATPESGPGSEPATSG SETP | 291 | GGTAGCGAACCGGCAACTTCCGGCTCTGAAACCCCA GGTACTTCTGAAAGCGCTACTCCTGAGTCTGGCCCA GGTAGCGAACCTGCTACCTCTGGCTCTGAAACCCCA | 292 |
| LCW0402_059_GFP-N_E11.ab1 | GSEPATSGSETPGSEP ATSGSETPGTSTEPSE GSAP | 293 | GGTAGCGAACCGGCAACCTCTGGCTCTGAAACTCCA GGTAGCGAACCTGCAACCTCCGGCTCTGAAACCCCA GGTACTTCTACTGAACCTTCTGAGGGCAGCGCACCA | 294 |

TABLE 9-continued

DNA and Amino Acid Sequences for 36-mer motifs

| File name | Amino acid sequence | SEQ ID NO: | Nucleotide sequence | SEQ ID NO: |
|---|---|---|---|---|
| LCW0402_060_GFP-N_F11.ab1 | GTSESATPESGPGSEPATSGSETPGSEPATSGSETP | 295 | GGTACTTCTGAAAGCGCTACCCCGGAATCTGGCCCA GGTAGCGAACCGGCTACTTCTGGTTCTGAAACCCCA GGTAGCGAACCGGCTACCTCCGGTTCTGAAACTCCA | 296 |
| LCW0402_061_GFP-N_G11.ab1 | GTSTEPSEGSAPGTSTEPSEGSAPGTSESATPESGP | 297 | GGTACCTCTACTGAACCTTCCGAAGGCAGCGCTCCA GGTACCTCTACCGAACCGTCCGAGGGCAGCGCACCA GGTACTTCTGAAAGCGCAACCCCTGAATCCGGTCCA | 298 |
| LCW0402_065_GFP-N_A12.ab1 | GSEPATSGSETPGTSESATPESGPGTSESATPESGP | 299 | GGTAGCGAACCGGCAACCTCTGGCTCTGAAACCCCA GGTACCTCTGAAAGCGCTACTCCGGAATCTGGTCCA GGTACTTCTGAAAGCGCTACTCCGGAATCCGGTCCA | 300 |
| LCW0402_066_GFP-N_B12.ab1 | GSEPATSGSETPGSEPATSGSETPGTSTEPSEGSAP | 301 | GGTAGCGAACCTGCTACCTCCGGCTCTGAAACTCCA GGTAGCGAACCGGCTACTTCCGGTTCTGAAACTCCA GGTACCTCTACCGAACCTTCCGAAGGCAGCGCACCA | 302 |
| LCW0402_067_GFP-N_C12.ab1 | GSEPATSGSETPGTSTEPSEGSAPGSEPATSGSETP | 303 | GGTAGCGAACCTGCTACTTCTGGTTCTGAAACTCCA GGTACTTCTACCGAACCGTCCGAGGGTAGCGCTCCA GGTAGCGAACCTGCTACTTCTGGTTCTGAAACTCCA | 304 |
| LCW0402_069_GFP-N_D12.ab1 | GTSTEPSEGSAPGTSTEPSEGSAPGSEPATSGSETP | 305 | GGTACCTCTACCGAACCGTCCGAGGGTAGCGCACCA GGTACCTCTACTGAACCGTCTGAGGGTAGCGCTCCA GGTAGCGAACCGGCAACCTCCGGTTCTGAAACTCCA | 306 |
| LCW0402_073_GFP-N_F12.ab1 | GTSTEPSEGSAPGSEPATSGSETPGSPAGSPTSTEE | 307 | GGTACTTCTACTGAACCTTCCGAAGGTAGCGCTCCA GGTAGCGAACCTGCTACTTCTGGTTCTGAAACCCCA GGTAGCCCGGCTGGCTCTCCGACCTCCACCGAGGAA | 308 |
| LCW0402_074_GFP-N_G12.ab1 | GSEPATSGSETPGSPAGSPTSTEEGTSESATPESGP | 309 | GGTAGCGAACCGGCTACTTCCGGCTCTGAGACTCCA GGTAGCCCAGCTGGTTCTCCAACCTCTACTGAGGAA GGTACTTCTGAAAGCGCTACCCCTGAATCTGGTCCA | 310 |
| LCW0402_075_GFP-N_H12.ab1 | GTSESATPESGPGSEPATSGSETPGTSESATPESGP | 311 | GGTACCTCTGAAAGCGCAACTCCTGAGTCTGGCCCA GGTAGCGAACCTGCTACCTCCGGCTCTGAGACTCCA GGTACCTCTGAAAGCGCAACCCCGGAATCTGGTCCA | 312 |

Example 3: Construction of XTEN_AF36 Segments

A codon library encoding sequences of 36 amino acid length was constructed. The sequences were designated XTEN_AF36. Its segments have the amino acid sequence [X]3 where X is a 12mer peptide with the sequence: GST-SESPSGTAP (SEQ ID NO: 313), GTSTPESGSASP (SEQ ID NO: 314), GTSPSGESSTAP (SEQ ID NO: 315), or GSTSSTAESPGP (SEQ ID NO: 316). The insert was obtained by annealing the following pairs of phosphorylated synthetic oligonucleotide pairs:

(SEQ ID NO: 317)
AF1for: AGGTTCTACYAGCGAATCYCCKTCTGGYACYGCWCC (SEQ ID NO: 318)
AF1rev: ACCTGGWGCRGTRCCAGAMGGRGATTCGCTRGTAGA (SEQ ID NO: 319)
AF2for: AGGTACYTCTACYCCKGAAAGCGGYTCYGCWTCTCC (SEQ ID NO: 320)
AF2rev: ACCTGGAGAWGCRGARCCGCTTTCMGGRGTAGARGT (SEQ ID NO: 321)
AF3for: AGGTACYTCYCCKAGCGGYGAATCTTCTACYGCWCC (SEQ ID NO: 322)
AF3rev: ACCTGGWGCRGTAGAAGATTCRCCGCTMGGRGARGT (SEQ ID NO: 323)
AF4for: AGGTTCYACYAGCTCTACYGCWGAATCTCCKGGYCC (SEQ ID NO: 324)
AF4rev: ACCTGGRCCMGGAGATTCWGCRGTAGAGCTRGTRGA We also annealed the phosphorylated oligonucleotide 3KpnIstopperFor: AGGTTCGTCTTCACTCGAGGGTAC (SEQ ID NO: 325) and the non-phosphorylated oligonucleotide pr_3KpnIstopperRev: CCTCGAGTGAAGACGA (SEQ ID NO: 326). The annealed oligonucleotide pairs were ligated, which resulted in a mixture of products with varying length that represents the varying number of 12mer repeats ligated to one BbsI/KpnI segment. The products corresponding to the length of 36 amino acids were isolated from the mixture by preparative agarose gel electrophoresis and ligated into the BsaI/KpnI digested stuffer vector pCW0359. Most of the clones in the resulting library designated LCW0403 showed green fluorescence after induction which shows that the sequence of XTEN_AF36 had been ligated in frame with the GFP gene and most sequences of XTEN_AF36 show good expression.

We screened 96 isolates from library LCW0403 for high level of fluorescence by stamping them onto agar plate containing IPTG. The same isolates were evaluated by PCR and 48 isolates were identified that contained segments with 36 amino acids as well as strong fluorescence. These isolates were sequenced and 44 clones were identified that contained correct XTEN_AF36 segments. The file names of the nucleotide and amino acid constructs for these segments are listed in Table 10.

TABLE 10

DNA and Amino Acid Sequences for 36-mer motifs

| File name | Amino acid sequence | SEQ ID NO: | Nucleotide sequence | SEQ ID NO: |
|---|---|---|---|---|
| LCW0403_004_GFP-N_A01.ab1 | GTSTPESGSASPGTSP SGESSTAPGTSPSGES STAP | 327 | GGTACTTCTACTCCGGAAAGCGGTTCCGCATCTCCA GGTACTTCTCCTAGCGGTGAATCTTCTACTGCTCAG GTACCTCTCCTAGCGGCGAATCTTCTACTGCTCCA | 328 |
| LCW0403_005_GFP-N_B01.ab1 | GTSPSGESSTAPGSTS STAESPGPGTSPSGES STAP | 329 | GGTACTTCTCCGAGCGGTGAATCTTCTACCGCACCA GGTTCTACTAGCTCTACCGCTGAATCTCCGGGCCAG GTACTTCTCCGAGCGGTGAATCTTCTACTGCTCCA | 330 |
| LCW0403_006_GFP-N_C01.ab1 | GSTSSTAESPGPGTSP SGESSTAPGTSTPESG SASP | 331 | GGTTCCACCAGCTCTACTGCTGAATCTCCTGGTCAG GTACCTCTCCTAGCGGTGAATCTTCTACTGCTCCAGG TACTTCTACTCCTGAAAGCGGCTCTGCTTCTCCA | 332 |
| LCW0403_007_GFP-N_D01.ab1 | GSTSSTAESPGPGSTS STAESPGPGTSPSGES STAP | 333 | GGTTCTACCAGCTCTACTGCAGAATCTCCTGGCCAG GTTCCACCAGCTCTACCGCAGAATCTCCGGGTCCAG GTACTTCCCCTAGCGGTGAATCTTCTACCGCACCA | 334 |
| LCW0403_008_GFP-N_E01.ab1 | GSTSSTAESPGPGTSP SGESSTAPGTSTPESG SASP | 335 | GGTTCTACTAGCTCTACTGCTGAATCTCCTGGCCAG GTACTTCTCCTAGCGGTGAATCTTCTACCGCTCCAGG TACCTCTACTCCGGAAAGCGGTTCTGCATCTCCA | 336 |
| LCW0403_010_GFP-N_F01.ab1 | GSTSSTAESPGPGTST PESGSASPGTSESPS GTAP | 337 | GGTTCTACCAGCTCTACCGCAGAATCTCCTGGTCAG GTACCTCTACTCCGAAAGCGGCTCTGCATCTCCAG GTTCTACTAGCGAATCTCCTTCTGGCACTGCACCA | 338 |
| LCW0403_011_GFP-N_G01.ab1 | GSTSSTAESPGPGTST PESGSASPGTSTPESG SASP | 339 | GGTTCTACTAGCTCTACTGCAGAATCTCCTGGCCAG GTACCTCTACTCCGAAAGCGGCTCTGCATCTCCAG GTACTTCTACCCCTGAAAGCGGTTCTGCATCTCCA | 340 |
| LCW0403_012_GFP-N_H01.ab1 | GSTSESPSGTAPGTSP SGESSTAPGSTSESPS GTAP | 341 | GGTTCTACCAGCGAATCTCCTTCTGGCACCGCTCCAG GTACCTCTCCTAGCGGCGAATCTTCTACCGCTCCAGG TTCTACTAGCGAATCTCCTTCTGGCACTGCACCA | 342 |
| LCW0403_013_GFP-N_A02.ab1 | GSTSSTAESPGPGSTS STAESPGPGTSPSGES STAP | 343 | GGTTCCACCAGCTCTACTGCAGAATCTCCGGGCCCA GGTTCTACTAGCTCTACTGCAGAATCTCCGGGTCAG GTACTTCTCCTAGCGGCGAATCTTCTACCGCTCCA | 344 |
| LCW0403_014_GFP-N_B02.ab1 | GSTSSTAESPGPGTST PESGSASPGSTSESPS GTAP | 345 | GGTTCCACTAGCTCTACTGCAGAATCTCCTGGCCCAG GTACCTCTACCCCTGAAAGCGGCTCTGCATCTCCAG GTTCTACCAGCGAATCCCCGTCTGGCACCGCACCA | 346 |
| LCW0403_015_GFP-N_C02.ab1 | GSTSSTAESPGPGSTS STAESPGPGTSPSGES STAP | 347 | GGTTCTACTAGCTCTACTGCTGAATCTCCGGGTCCAG GTTCTACCAGCTCTACTGCTGAATCTCCTGGTCCAGG TACCTCCCCGAGCGGTGAATCTTCTACTGCACCA | 348 |
| LCW0403_017_GFP-N_D02.ab1 | GSTSSTAESPGPGSTS ESPSGTAPGSTSSTAE SPGP | 349 | GGTTCTACCAGCTCTACCGCTGAATCTCCTGGCCCAG GTTCTACCAGCGAATCCCCGTCTGGCACCGCACCAG GTTCTACTAGCTCTACCGCTGAATCTCCGGGTCCA | 350 |
| LCW0403_018_GFP-N_E02.ab1 | GSTSSTAESPGPGSTS STAESPGPGTSSTAE SPGP | 351 | GGTTCTACCAGCTCTACCGCAGAATCTCCTGGCCCA GGTTCCACCAGCTCTACCGCTGAATCTCCTGGTCAG GTTCTACTAGCTCTACCGCTGAATCTCCTGGTCCA | 352 |
| LCW0403_019_GFP-N_F02.ab1 | GSTSESPSGTAPGSTS STAESPGPGSTSSTAE SPGP | 353 | GGTTCTACTAGCGAATCCCCTTCTGGTACTGCTCCAG GTTCCACTAGCTCTACCGCTGAATCTCCTGGCCCAGG TTCCACTAGCTCTACTGCAGAATCTCCTGGTCCA | 354 |
| LCW0403_023_GFP-N_H02.ab1 | GSTSESPSGTAPGSTS ESPSGTAPGSTSESPS GTAP | 355 | GGTTCTACTAGCGAATCTCCTTCTGGTACCGCTCCAG GTTCTACCAGCGAATCCCCGTCTGGTACTGCTCCAGG TTCTACCAGCGAATCTCCTTCTGGTACTGCACCA | 356 |
| LCW0403_024_GFP-N_A03.ab1 | GSTSSTAESPGPGSTS STAESPGPGSTSSTAE SPGP | 357 | GGTTCCACCAGCTCTACTGCTGAATCTCCTGGCCCAG GTTCTACCAGCTCTACTGCTGAATCTCCGGGCCCAGG TTCCACCAGCTCTACCGCTGAATCTCCGGGTCCA | 358 |
| LCW0403_025_GFP-N_B03.ab1 | GSTSSTAESPGPGSTS STAESPGPGTSPSGES STAP | 359 | GGTTCCACTAGCTCTACCGCAGAATCTCCTGGTCCAG GTTCTACCAGCTCTACTGCTGAATCTCCGGGTCCAGG TACCTCCCCTAGCGGCGAATCTTCTACCGCTCCA | 360 |
| LCW0403_028_GFP-N_D03.ab1 | GSSPSASTGTGPGSST PSGATGSPGSSTPSGA TGSP | 361 | GGTTCTAGCCCTTCTGCTTCCACCGGTACCGGCCCAG GTAGCTCTACTCCGTCTGGTGCAACTGGCTCTCCAGG TAGCTCTACTCCGTCTGGTGCAACCGGCTCCCCA | 362 |
| LCW0403_029_GFP-N_E03.ab1 | GTSPSGESSTAPGTST PESGSASPGSTSSTAE SPGP | 363 | GGTACTTCCCCTAGCGGTGAATCTTCTACTGCTCCAG GTACCTCTACTCCGGAAAGCGGCTCCGCATCTCCAG GTTCTACTAGCTCTACTGCTGAATCTCCTGGTCCA | 364 |

TABLE 10-continued

DNA and Amino Acid Sequences for 36-mer motifs

| File name | Amino acid sequence | SEQ ID NO: | Nucleotide sequence | SEQ ID NO: |
|---|---|---|---|---|
| LCW0403_030_GFP-N_F03.ab1 | GSTSSTAESPGPGSTS STAESPGPGTSTPESG SASP | 365 | GGTTCTACTAGCTCTACCGCTGAATCTCCGGGTCCAG GTTCTACCAGCTCTACTGCAGAATCTCCTGGCCCAGG TACTTCTACTCCGGAAAGCGGTTCCGCTTCTCCA | 366 |
| LCW0403_031_GFP-N_G03.ab1 | GTSPSGESSTAPGSTS STAESPGPGTSTPESG SASP | 367 | GGTACTTCTCCTAGCGGTGAATCTTCTACCGCTCAG GTTCTACCAGCTCTACTGCTGAATCTCCTGGCCCAGG TACTTCTACCCCGGAAAGCGGCTCCGCTTCTCCA | 368 |
| LCW0403_033_GFP-N_H03.ab1 | GSTSESPSGTAPGSTS STAESPGPGTSSSTAE SPGP | 369 | GGTTCTACTAGCGAATCCCCTTCTGGTACTGCACCAG GTTCTACCAGCTCTACTGCTGAATCTCCGGGCCCAGG TTCCACCAGCTCTACCGCAGAATCTCCTGGTCCA | 370 |
| LCW0403_035_GFP-N_A04.ab1 | GSTSSTAESPGPGSTS ESPSGTAPGSTSSTAE SPGP | 371 | GGTTCCACCAGCTCTACCGCTGAATCTCCGGGCCCA GGTTCTACCAGCGAATCCCCTTCTGGCACTGCACCA GGTTCTACTAGCTCTACCGCAGAATCTCCGGGCCCA | 372 |
| LCW0403_036_GFP-N_B04.ab1 | GSTSSTAESPGPGTSP SGESSTAPGTSTPESG SASP | 373 | GGTTCTACCAGCTCTACTGCTGAATCTCCGGGTCAG GTACTTCCCCGAGCGGTGAATCTTCTACTGCACCAG GTACTTCTACTCCGGAAAGCGGTTCCGCTTCTCCA | 374 |
| LCW0403_039_GFP-N_C04.ab1 | GSTSESPSGTAPGSTS ESPSGTAPGTSPSGES STAP | 375 | GGTTCTACCAGCGAATCTCCTTCTGGCACCGCTCAG GTTCTACTAGCGAATCCCGTCTGGTACCGCACCAG GTACTTCTCCTAGCGGCGAATCTTCTACCGCACCA | 376 |
| LCW0403_041_GFP-N_D04.ab1 | GSTSESPSGTAPGSTS ESPSGTAPGTSTPESG SASP | 377 | GGTTCTACCAGCGAATCCCCTTCTGGTACTGCTCAG GTTCTACCAGCGAATCCCCTTCTGGCACCGCACCAG GTACTTCTACCCCTGAAAGCGGCTCCGCTTCTCCA | 378 |
| LCW0403_044_GFP-N_E04.ab1 | GTSTPESGSASPGSTS STAESPGPGTSSSTAE SPGP | 379 | GGTACCTCTACTCCTGAAAGCGGTTCTGCATCTCCAG GTTCCACTAGCTCTACCGCAGAATCTCCGGGCCCAG GTTCTACTAGCTCTACTGCTGAATCTCCTGGCCCA | 380 |
| LCW0403_046_GFP-N_F04.ab1 | GSTSESPSGTAPGSTS ESPSGTAPGTSPSGES STAP | 381 | GGTTCTACCAGCGAATCCCCTTCTGGCACTGCACCA GGTTCTACTAGCGAATCCCCTTCTGGTACCGCACCAG GTACTTCTCCGAGCGGCGAATCTTCTACTGCTCCA | 382 |
| LCW0403_047_GFP-N_G04.ab1 | GSTSSTAESPGPGSTS STAESPGPGSTSESPS GTAP | 383 | GGTTCTACTAGCTCTACCGCTGAATCTCCTGGCCCAG GTTCCACTAGCTCTACCGCAGAATCTCCGGGCCCAG GTTCTACTAGCGAATCCCCTTCTGGTACCGCTCCA | 384 |
| LCW0403_049_GFP-N_H04.ab1 | GSTSSTAESPGPGSTS STAESPGPGTSTPESG SASP | 385 | GGTTCCACCAGCTCTACTGCAGAATCTCCTGGCCCA GGTTCTACTAGCTCTACCGCAGAATCTCCTGGTCCAG GTACCTCTACTCCTGAAAGCGGTTCCGCATCTCCA | 386 |
| LCW0403_051_GFP-N_A05.ab1 | GSTSSTAESPGPGSTS STAESPGPGSTSESPS GTAP | 387 | GGTTCTACTAGCTCTACTGCTGAATCTCCGGGCCCAG GTTCTACTAGCTCTACCGCTGAATCTCCGGGTCCAGG TTCTACTAGCGAATCTCCTTCTGGTACCGCTCCA | 388 |
| LCW0403_053_GFP-N_B05.ab1 | GTSPSGESSTAPGSTS ESPSGTAPGSTSSTAE SPGP | 389 | GGTACCTCCCCGAGCGGTGAATCTTCTACTGCACCA GGTTCTACTAGCGAATCCCCTTCTGGTACTGCTCCAG GTTCCACCAGCTCTACTGCAGAATCTCCGGGTCCA | 390 |
| LCW0403_054_GFP-N_C05.ab1 | GSTSESPSGTAPGTSP SGESSTAPGSTSSTAE SPGP | 391 | GGTTCTACTAGCGAATCCCCGTCTGGTACTGCTCCAG GTACTTCCCCTAGCGGTGAATCTTCTACTGCTCCAGG TTCTACCAGCTCTACCGCAGAATCTCCGGGTCCA | 392 |
| LCW0403_057_GFP-N_D05.ab1 | GSTSSTAESPGPGSTS ESPSGTAPGTSPSGES STAP | 393 | GGTTCTACCAGCTCTACCGCTGAATCTCCTGGCCCAG GTTCTACTAGCGAATCTCCGTCTGGCACCGCACCAG GTACTTCCCCTAGCGGTGAATCTTCTACTGCACCA | 394 |
| LCW0403_058_GFP-N_E05.ab1 | GSTSESPSGTAPGSTS ESPSGTAPGTSTPESG SASP | 395 | GGTTCTACTAGCGAATCTCCTTCTGGCACTGCACCAG GTTCTACCAGCGAATCTCCGTCTGGCACTGCACCAG GTACCTCTACCCCTGAAAGCGGTTCCGCTTCTCCA | 396 |
| LCW0403_060_GFP-N_F05.ab1 | GTSTPESGSASPGSTS ESPSGTAPGSTSSTAE SPGP | 397 | GGTACCTCTACTCCGGAAAGCGGTTCCGCATCTCCA GGTTCTACCAGCGAATCCCCGTCTGGCACCGCACCA GGTTCTACTAGCTCTACTGCTGAATCTCCGGGCCCA | 398 |
| LCW0403_063_GFP-N_G05.ab1 | GSTSSTAESPGPGTSP SGESSTAPGTSPSGES STAP | 399 | GGTTCTACTAGCTCTACTGCAGAATCTCCGGGCCCA GGTACCTCTCCTAGCGGTGAATCTTCTACCGCTCCAG GTACTTCTCCGAGCGGTGAATCTTCTACCGCTCCA | 400 |
| LCW0403_064_GFP-N_H05.ab1 | GTSPSGESSTAPGTSP SGESSTAPGTSPSGES STAP | 401 | GGTACCTCCCCTAGCGGCGAATCTTCTACTGCTCCAG GTACCTCTCCTAGCGGCGAATCTTCTACCGCTCCAGG TACCTCCCCTAGCGGTGAATCTTCTACCGCACCA | 402 |

TABLE 10-continued

DNA and Amino Acid Sequences for 36-mer motifs

| File name | Amino acid sequence | SEQ ID NO: | Nucleotide sequence | SEQ ID NO: |
|---|---|---|---|---|
| LCW0403_065_GFP-N_A06.ab1 | GSTSSTAESPGPGTST PESGSASPGSTSESPS GTAP | 403 | GGTTCCACTAGCTCTACTGCTGAATCTCCTGGCCCAG GTACTTCTACTCCGGAAAGCGGTTCCGCTTCTCCAGG TTCTACTAGCGAATCTCCGTCTGGCACCGCACCA | 404 |
| LCW0403_066_GFP-N_B06.ab1 | GSTSESPSGTAPGTSP SGESSTAPGTSPSGES STAP | 405 | GGTTCTACTAGCGAATCTCCGTCTGGCACTGCTCCAG GTACTTCTCCTAGCGGTGAATCTTCTACCGCTCCAGG TACTTCCCCTAGCGGCGAATCTTCTACCGCTCCA | 406 |
| LCW0403_067_GFP-N_C06.ab1 | GSTSESPSGTAPGTST PESGSASPGSTSSTAE SPGP | 407 | GGTTCTACTAGCGAATCTCCTTCTGGTACCGCTCCAG GTACTTCTACCCCTGAAAGCGGCTCCGCTTCTCCAGG TTCCACTAGCTCTACCGCTGAATCTCCGGGTCCA | 408 |
| LCW0403_068_GFP-N_D06.ab1 | GSTSSTAESPGPGSTS STAESPGPGSTSESPS GTAP | 409 | GGTTCCACTAGCTCTACTGCTGAATCTCCTGGCCCAG GTTCTACCAGCTCTACCGCTGAATCTCCTGGCCCAGG TTCTACCAGCGAATCTCCGTCTGGCACCGCACCA | 410 |
| LCW0403_069_GFP-N_E06.ab1 | GSTSESPSGTAPGTST PESGSASPGTSTPESG SASP | 411 | GGTTCTACTAGCGAATCCCGTCTGGTACCGCACCA GGTACTTCTACCCCGGAAAGCGGCTCTGCTTCTCCAG GTACTTCTACCCCGGAAAGCGGCTCCGCATCTCCA | 412 |
|  |  |  |  | 414 |
| LCW0403_070_GFP-N_F06.ab1 | GSTSESPSGTAPGTST PESGSASPGTSTPESG SASP | 413 | GGTTCTACTAGCGAATCCCGTCTGGTACTGCTCCAG GTACTTCTACTCCTGAAAGCGGTTCCGCTTCTCCAGG TACCTCTACTCCGGAAAGCGGTTCTGCATCTCCA |  |

Example 4: Construction of XTEN_AG36 Segments

A codon library encoding sequences of 36 amino acid length was constructed. The sequences were designated XTEN_AG36. Its segments have the amino acid sequence [X]$_3$ where X is a 12mer peptide with the sequence: GTPGS-GTASSSP (SEQ ID NO: 415), GSSTPSGATGSP (SEQ ID NO: 416), GSSPSASTGTGP (SEQ ID NO: 417), or GASPGTSSTGSP (SEQ ID NO: 418). The insert was obtained by annealing the following pairs of phosphorylated synthetic oligonucleotide pairs:

```
                                      (SEQ ID NO: 419)
AG1for: AGGTACYCCKGGYAGCGGTACYGCWTCTTCYTCTCC (SEQ ID NO: 420)
AG1rev: ACCTGGAGARGAAGAWGCRGTACCGCTRCCMGGRGT (SEQ ID NO: 421)
AG2for: AGGTAGCTCTACYCCKTCTGGTGCWACYGGYTCYCC (SEQ ID NO: 422)
AG2rev: ACCTGGRGARCCRGTWGCACCAGAMGGRGTAGAGCT (SEQ ID NO: 423)
AG3for: AGGTTCTAGCCCKTCTGCWTCYACYGGTACYGGYCC (SEQ ID NO: 424)
AG3rev: ACCTGGRCCRGTACCRGTRGAWGCAGAMGGGCTAGA
```

```
                                      (SEQ ID NO: 425)
AG4for: AGGTGCWTCYCCKGGYACYAGCTCTACYGGTTCTCC (SEQ ID NO: 426)
AG4rev: ACCTGGAGAACCRGTAGAGCTRGTRCCMGGRGAWGC
```

We also annealed the phosphorylated oligonucleotide 3KpnIstopperFor: AGGTTCGTCTTCACTCGAGGGTAC (SEQ ID NO: 427) and the non-phosphorylated oligonucleotide pr_3KpnIstopperRev: CCTCGAGTGAAGACGA (SEQ ID NO: 428). The annealed oligonucleotide pairs were ligated, which resulted in a mixture of products with varying length that represents the varying number of 12mer repeats ligated to one BbsI/KpnI segment. The products corresponding to the length of 36 amino acids were isolated from the mixture by preparative agarose gel electrophoresis and ligated into the BsaI/KpnI digested stuffer vector pCW0359. Most of the clones in the resulting library designated LCW0404 showed green fluorescence after induction which shows that the sequence of XTEN_AG36 had been ligated in frame with the GFP gene and most sequences of XTEN_AG36 show good expression.

We screened 96 isolates from library LCW0404 for high level of fluorescence by stamping them onto agar plate containing IPTG. The same isolates were evaluated by PCR and 48 isolates were identified that contained segments with 36 amino acids as well as strong fluorescence. These isolates were sequenced and 44 clones were identified that contained correct XTEN_AG36 segments. The file names of the nucleotide and amino acid constructs for these segments are listed in Table 11.

TABLE 11

DNA and Amino Acid Sequences for 36-mer motifs

| File name | Amino acid sequence | SEQ ID NO: | Nucleotide sequence | SEQ ID NO: |
|---|---|---|---|---|
| LCW0404_001_GFP-N_A07.ab1 | GASPGTSSTGSPGTPG SGTASSSPGSSTPSGA TGSP | 429 | GGTGCATCCCCGGGCACTAGCTCTACCGGTTCTCCA GGTACTCCTGGTAGCGGTACTGCTTCTTCTTCTCCAG GTAGCTCTACTCCTTCTGGTGCTACTGGTTCTCCA | 430 |

TABLE 11-continued

DNA and Amino Acid Sequences for 36-mer motifs

| File name | Amino acid sequence | SEQ ID NO: | Nucleotide sequence | SEQ ID NO: |
|---|---|---|---|---|
| LCW0404_003_GFP-N_B07.ab1 | GSSTPSGATGSPGSSP SASTGTGPGSSTPSGA TGSP | 431 | GGTAGCTCTACCCCTTCTGGTGCTACCGGCTCTCCAG GTTCTAGCCCGTCTGCTTCTACCGGTACCGGTCCAGG TAGCTCTACCCCTTCTGGTGCTACTGGTTCTCCA | 432 |
| LCW0404_006_GFP-N_C07.ab1 | GASPGTSSTGSPGSSP SASTGTGPGSSTPSGA TGSP | 433 | GGTGCATCTCCGGGTACTAGCTCTACCGGTTCTCCAG GTTCTAGCCCTTCTGCTTCCACTGGTACCGGCCCAGG TAGCTCTACCCCGTCTGGTGCTACTGGTTCCCCA | 434 |
| LCW0404_007_GFP-N_D07.ab1 | GTPGSGTASSSPGSST PSGATGSPGASPGTSS TGSP | 435 | GGTACTCCGGGCAGCGGTACTGCTTCTTCCTCTCCAG GTAGCTCTACCCCTTCTGGTGCAACTGGTTCCCCAGG TGCATCCCTGGTACTAGCTCTACCGGTTCTCCA | 436 |
| LCW0404_009_GFP-N_E07.ab1 | GTPGSGTASSSPGASP GTSSTGSPGSRPSAST GTGP | 437 | GGTACCCCTGGCAGCGGTACTGCTTCTTCTTCTCCAG GTGCTTCCCCTGGTACCAGCTCTACCGGTTCTCCAGG TTCTAGACCTTCTGCATCCACCGGTACTGGTCCA | 438 |
| LCW0404_011_GFP-N_F07.ab1 | GASPGTSSTGSPGSST PSGATGSPGASPGTSS TGSP | 439 | GGTGCATCTCCTGGTACCAGCTCTACCGGTTCTCCAG GTAGCTCTACTCCTTCTGGTGCTACTGGCTCTCCAGG TGCTTCCCCGGGTACCAGCTCTACCGGTTCTCCA | 440 |
| LCW0404_012_GFP-N_G07.ab1 | GTPGSGTASSSPGSST PSGATGSPGSSTPSGA TGSP | 441 | GGTACCCCGGGCAGCGGTACCGCATCTTCCTCTCCA GGTAGCTCTACCCCGTCTGGTACCGGTTCCCCAG GTAGCTCTACCCCGTCTGGTGCAACCGGCTCCCCA | 442 |
| LCW0404_014_GFP-N_H07.ab1 | GASPGTSSTGSPGASP GTSSTGSPGASPGTSS TGSP | 443 | GGTGCATCTCCGGGCACTAGCTCTACTGGTTCTCCAG GTGCATCCCTGGCACTAGCTCTACTGGTTCTCCAGG TGCTTCTCCTGGTACCAGCTCTACTGGTTCTCCA | 444 |
| LCW0404_015_GFP-N_A08.ab1 | GSSTPSGATGSPGSSP SASTGTGPGASPGTSS TGSP | 445 | GGTAGCTCTACTCCGTCTGGTGCAACCGGCTCCCCA GGTTCTAGCCCGTCTGCTTCCACTGGTACTGGCCCAG GTGCTTCCCCGGGCACCAGCTCTACTGGTTCTCCA | 446 |
| LCW0404_016_GFP-N_B08.ab1 | GSSTPSGATGSPGSST PSGATGSPGTPGSGT ASSSP | 447 | GGTAGCTCTACTCCTTCTGGTGCTACCGGTTCCCCAG GTAGCTCTACTCCTTCTGGTGCTACTGGTTCCCCAGG TACTCCGGGCAGCGGTACTGCTTCTTCCTCTCCA | 448 |
| LCW0404_017_GFP-N_C08.ab1 | GSSTPSGATGSPGSST PSGATGSPGASPGTSS TGSP | 449 | GGTAGCTCTACTCCGTCTGGTGCAACCGGTTCCCCAG GTAGCTCTACTCCTTCTGGTGCTACTGGCTCCCCAGG TGCATCCCTGGCACCAGCTCTACCGGTTCTCCA | 450 |
| LCW0404_018_GFP-N_D08.ab1 | GTPGSGTASSSPGSSP SASTGTGPGSSTPSGA TGSP | 451 | GGTACTCCTGGTAGCGGTACCGCATCTTCCTCTCCAG GTTCTAGCCCTTCTGCATCTACCGGTACCGGTCCAGG TAGCTCTACTCCTTCTGGTGCTACTGGCTCTCCA | 452 |
| LCW0404_023_GFP-N_F08.ab1 | GASPGTSSTGSPGSSP SASTGTGPGTPGSGT ASSSP | 453 | GGTGCTTCCCCGGGCACTAGCTCTACCGGTTCTCCAG GTTCTAGCCCTTCTGCATCTACTGGTACTGGCCCAGG TACTCCGGGCAGCGGTACTGCTTCTTCCTCTCCA | 454 |
| LCW0404_025_GFP-N_G08.ab1 | GSSTPSGATGSPGSST PSGATGSPGASPGTSS TGSP | 455 | GGTAGCTCTACTCCGTCTGGTGCTACCGGCTCTCCAG GTAGCTCTACCCCTTCTGGTGCAACCGGCTCCCCAGG TGCTTCTCCGGGTACCAGCTCTACTGGTTCTCCA | 456 |
| LCW0404_029_GFP-N_A09.ab1 | GTPGSGTASSSPGSST PSGATGSPGSSPSAST GTGP | 457 | GGTACCCCTGGCAGCGGTACCGCTTCTTCCTCTCCAG GTAGCTCTACCCCGTCTGGTGCTACTGGCTCTCCAGG TTCTAGCCCGTCTGCATCTACCGGTACCGGCCCA | 458 |
| LCW0404_030_GFP-N_B09.ab1 | GSSTPSGATGSPGTPG SGTASSSPGTPGSGTA SSSP | 459 | GGTAGCTCTACTCCTTCTGGTGCAACCGGCTCCCCAG GTACCCCGGGCAGCGGTACCGCATCTTCCTCTCCAG GTACTCCGGGTAGCGGTACTGCTTCTTCTTCTCCA | 460 |
| LCW0404_031_GFP-N_C09.ab1 | GTPGSGTASSSPGSST PSGATGSPGASPGTSS TGSP | 461 | GGTACCCCGGGTAGCGGTACTGCTTCTTCCTCTCCAG GTAGCTCTACCCCTTCTGGTGCAACCGGCTCTCCAGG TGCTTCTCCGGGCACCAGCTCTACCGGTTCTCCA | 462 |
| LCW0404_034_GFP-N_D09.ab1 | GSSTPSGATGSPGSST PSGATGSPGASPGTSS TGSP | 463 | GGTAGCTCTACCCCGTCTGGTGCTACCGGCTCTCCAG GTAGCTCTACCCCGTCTGGTGCAACCGGCTCCCCAG GTGCATCCCGGGTACTAGCTCTACCGGTTCTCCA | 464 |
| LCW0404_035_GFP-N_E09.ab1 | GASPGTSSTGSPGTPG SGTASSSPGSSTPSGA TGSP | 465 | GGTGCTTCTCCGGGCACCAGCTCTACTGGTTCTCCAG GTACCCCGGGCAGCGGTACCGCATCTTCCTCTCCAG GTAGCTCTACTCCTTCTGGTGCAACTGGTTCTCCA | 466 |
| LCW0404_036_GFP-N_F09.ab1 | GSSPSASTGTGPGSST PSGATGSPGTPGSGT ASSSP | 467 | GGTTCTAGCCCGTCTGCTTCCACCGGTACTGGCCCAG GTAGCTCTACCCCGTCTGGTGCAACTGGTTCCCCAGG TACCCCTGGTAGCGGTACCGCTTCTTCTTCTCCA | 468 |

TABLE 11-continued

DNA and Amino Acid Sequences for 36-mer motifs

| File name | Amino acid sequence | SEQ ID NO: | Nucleotide sequence | SEQ ID NO: |
|---|---|---|---|---|
| LCW0404_037_GFP-N_G09.ab1 | GASPGTSSTGSPGSSP SASTGTGPGSSTPSGA TGSP | 469 | GGTGCTTCTCCGGGCACCAGCTCTACTGGTTCTCCAG GTTCTAGCCCTTCTGCATCCACCGGTACCGGTCCAGG TAGCTCTACCCCTTCTGGTGCAACCGGCTCTCCA | 470 |
| LCW0404_040_GFP-N_H09.ab1 | GASPGTSSTGSPGSST PSGATGSPGSSTPSGA TGSP | 471 | GGTGCATCCCGGGCACCAGCTCTACCGGTTCTCCA GGTAGCTCTACCCCGTCTGGTGCTACCGGCTCTCCAG GTAGCTCTACCCCGTCTGGTGCTACTGGCTCTCCA | 472 |
| LCW0404_041_GFP-N_A10.ab1 | GTPGSGTASSSPGSST PSGATGSPGTPGSGT ASSSP | 473 | GGTACCCCTGGTAGCGGTACTGCTTCTTCCTCTCCAG GTAGCTCTACTCCGTCTGGTGCTACCGGTTCTCCAGG TACCCCGGGTAGCGGTACCGCATCTTCTTCTCCA | 474 |
| LCW0404_043_GFP-N_C10.ab1 | GSSPSASTGTGPGSST PSGATGSPGSSTPSGA TGSP | 475 | GGTTCTAGCCCTTCTGCTTCCACCGGTACTGGCCCAG GTAGCTCTACCCCTTCTGGTGCTACCGGCTCCCCAGG TAGCTCTACTCCTTCTGGTGCAACTGGCTCTCCA | 476 |
| LCW0404_045_GFP-N_D10.ab1 | GASPGTSSTGSPGSSP SASTGTGPGSSPSAST GTGP | 477 | GGTGCTTCTCCTGGCACCAGCTCTACTGGTTCTCCAG GTTCTAGCCCTTCTGCTTCTACCGGTACTGGTCCAGG TTCTAGCCCTTCTGCATCCACTGGTACTGGTCCA | 478 |
| LCW0404_047_GFP-N_F10.ab1 | GTPGSGTASSSPGASP GTSSTGSPGASPGTSS TGSP | 479 | GGTACTCCTGGCAGCGGTACCGCTTCTTCTTCTCCAG GTGCTTCTCCTGGTACTAGCTCTACTGGTTCTCCAGG TGCTTCTCCGGGCACTAGCTCTACTGGTTCTCCA | 480 |
| LCW0404_048_GFP-N_G10.ab1 | GSSTPSGATGSPGASP GTSSTGSPGSSTPSGA TGSP | 481 | GGTAGCTCTACCCCGTCTGGTGCTACCGGTTCCCAG GTGCTTCTCCTGGTACTAGCTCTACCGGTTCTCCAGG TAGCTCTACCCCGTCTGGTGCTACTGGCTCTCCA | 482 |
| LCW0404_049_GFP-N_H10.ab1 | GSSTPSGATGSPGTPG SGTASSSPGSSTPSGA TGSP | 483 | GGTAGCTCTACCCCGTCTGGTGCTACTGGTCTCCAG GTACTCCGGGCAGCGGTACTGCTTCTTCCTCTCCAGG TAGCTCTACCCCTTCTGGTGCTACTGGCTCTCCA | 484 |
| LCW0404_050_GFP-N_A11.ab1 | GASPGTSSTGSPGSSP SASTGTGPGSSTPSGA TGSP | 485 | GGTGCATCTCCTGGTACCAGCTCTACTGGTTCTCCAG GTTCTAGCCCTTCTGCTTCTACCGGTACCGGTCCAGG TAGCTCTACTCCTTCTGGTGCTACCGGTTCTCCA | 486 |
| LCW0404_051_GFP-N_B11.ab1 | GSSTPSGATGSPGSST PSGATGSPGSSTPSGA TGSP | 487 | GGTAGCTCTACCCCGTCTGGTGCTACTGGCTCTCCAG GTAGCTCTACTCCTTCTGGTGCTACTGGTTCCCCAGG TAGCTCTACCCCGTCTGGTGCAACTGGCTCTCCA | 488 |
| LCW0404_052_GFP-N_C11.ab1 | GASPGTSSTGSPGTPG SGTASSSPGASPGTSS TGSP | 489 | GGTGCATCCCGGGTACCAGCTCTACCGGTTCTCCA GGTACTCCTGGCAGCGGTACTGCATCTTCCTCTCCAG GTGCTTCTCCGGGCACCAGCTCTACTGGTTCTCCA | 490 |
| LCW0404_053_GFP-N_D11.ab1 | GSSTPSGATGSPGSSP SASTGTGPGASPGTSS TGSP | 491 | GGTAGCTCTACTCCTTCTGGTGCAACTGGTTCTCCAG GTTCTAGCCCGTCTGCATCCACTGGTACCGGTCCAGG TGCTTCCCCTGGCACCAGCTCTACCGGTTCTCCA | 492 |
| LCW0404_057_GFP-N_E11.ab1 | GASPGTSSTGSPGSST PSGATGSPGSSPSAST GTGP | 493 | GGTGCATCTCCTGGTACTAGCTCTACTGGTTCTCCAG GTAGCTCTACTCCGTCTGGTGCAACCGGCTCTCCAGG TTCTAGCCCTTCTGCATCTACCGGTACTGGTCCA | 494 |
| LCW0404_060_GFP-N_F11.ab1 | GTPGSGTASSSPGSST PSGATGSPGASPGTSS TGSP | 495 | GGTACTCCTGGCAGCGGTACCGCATCTTCCTCTCCAG GTAGCTCTACTCCGTCTGGTGCAACTGGTTCCCCAGG TGCTTCTCCGGGTACCAGCTCTACCGGTTCTCCA | 496 |
| LCW0404_062_GFP-N_G11.ab1 | GSSTPSGATGSPGTPG SGTASSSPGSSTPSGA TGSP | 497 | GGTAGCTCTACCCCGTCTGGTGCAACCGGCTCCCA GGTACTCCTGGTAGCGGTACCGCTTCTTCTTCTCCAG GTAGCTCTACTCCGTCTGGTGCTACCGGCTCCCCA | 498 |
| LCW0404_066_GFP-N_H11.ab1 | GSSPSASTGTGPGSSP SASTGTGPGASPGTSS TGSP | 499 | GGTTCTAGCCCTTCTGCATCCACCGGTACCGGCCCAG GTTCTAGCCCTCTGCTTCTACCGGTACTGGTCCAGG TGCTTCTCCGGGTACTAGCTCTACTGGTTCTCCA | 500 |
| LCW0404_067_GFP-N_A12.ab1 | GTPGSGTASSSPGSST PSGATGSPGSNPSAST GTGP | 501 | GGTACCCCGGGTAGCGGTACCGCTTCTTCTTCTCCAG GTAGCTCTACTCCGTCTGGTGCTACCGGCTCTCCAGG TTCTAACCCTTCTGCATCCACCGGTACCGGCCCA | 502 |
| LCW0404_068_GFP-N_B12.ab1 | GSSPSASTGTGPGSST PSGATGSPGASPGTSS TGSP | 503 | GGTTCTAGCCCTTCTGCATCTACTGGTACTGGCCCAG GTAGCTCTACTCCTTCTGGTACCGGCTCTCCAGG TGCTTCTCCGGGTACTAGCTCTACCGGTTCTCCA | 504 |
| LCW0404_069_GFP-N_C12.ab1 | GSSTPSGATGSPGASP GTSSTGSPGTPGSGTA SSSP | 505 | GGTAGCTCTACCCCTTCTGGTGCAACCGGCTCTCCAG GTGCATCCCGGGTACCAGCTCTACCGGTTCTCCAGG TACTCCGGGTAGCGGTACCGCTTCTTCCTCTCCA | 506 |

TABLE 11-continued

DNA and Amino Acid Sequences for 36-mer motifs

| File name | Amino acid sequence | SEQ ID NO: | Nucleotide sequence | SEQ ID NO: |
|---|---|---|---|---|
| LCW0404_070_GFP-N_D12.ab1 | GSSTPSGATGSPGSST PSGATGSPGSSTPSGA TGSP | 507 | GGTAGCTCTACTCCGTCTGGTGCAACCGGTTCCCCAG GTAGCTCTACCCCTTCTGGTGCAACCGGCTCCCCAGG TAGCTCTACCCCTTCTGGTGCAACTGGCTCTCCA | 508 |
| LCW0404_073_GFP-N_E12.ab1 | GASPGTSSTGSPGTPG SGTASSSPGSSTPSGA TGSP | 509 | GGTGCTTCTCCTGGCACTAGCTCTACCGGTTCTCCAG GTACCCCTGGTAGCGGTACCGCATCTTCCTCTCCAGG TAGCTCTACTCCTTCTGGTGCTACTGGTTCCCCA | 510 |
| LCW0404_075_GFP-N_F12.ab1 | GSSTPSGATGSPGSSP SASTGTGPGSSPSAST GTGP | 511 | GGTAGCTCTACCCCGTCTGGTGCTACTGGCTCCCCAG GTTCTAGCCCTTCTGCATCCACCGGTACCGGTCCAGG TTCTAGCCCGTCTGCATCTACTGGTACTGGTCCA | 512 |
| LCW0404_080_GFP-N_G12.ab1 | GASPGTSSTGSPGSSP SASTGTGPGSSPSAST GTGP | 513 | GGTGCTTCCCCGGGCACCAGCTCTACTGGTTCTCCAG GTTCTAGCCCGTCTGCTTCTACTGGTACTGGTCCAGG TTCTAGCCCTTCTGCTTCCACTGGTACTGGTCCA | 514 |
| LCW0404_081_GFP-N_H12.ab1 | GASPGTSSTGSPGSSP SASTGTGPGTPGSGT ASSSP | 515 | GGTGCTTCCCCGGGTACCAGCTCTACCGGTTCTCCAG GTTCTAGCCCTTCTGCTTCTACCGGTACCGGTCCAGG TACCCCTGGCAGCGGTACCGCATCTTCCTCTCCA | 516 |

Example 5: Construction of XTEN_AE864

XTEN_AE864 was constructed from serial dimerization of XTEN_AE36 to AE72, 144, 288, 576 and 864. A collection of XTEN_AE72 segments was constructed from 37 different segments of XTEN_AE36. Cultures of E. coli harboring all 37 different 36-amino acid segments were mixed and plasmid was isolated. This plasmid pool was digested with BsaI/NcoI to generate the small fragment as the insert. The same plasmid pool was digested with BbsI/NcoI to generate the large fragment as the vector. The insert and vector fragments were ligated resulting in a doubling of the length and the ligation mixture was transformed into BL21Gold(DE3) cells to obtain colonies of XTEN_AE72.

This library of XTEN_AE72 segments was designated LCW0406. All clones from LCW0406 were combined and dimerized again using the same process as described above yielding library LCW0410 of XTEN_AE144. All clones from LCW0410 were combined and dimerized again using the same process as described above yielding library LCW0414 of XTEN_AE288. Two isolates LCW0414.001 and LCW0414.002 were randomly picked from the library and sequenced to verify the identities. All clones from LCW0414 were combined and dimerized again using the same process as described above yielding library LCW0418 of XTEN_AE576. We screened 96 isolates from library LCW0418 for high level of GFP fluorescence. 8 isolates with right sizes of inserts by PCR and strong fluorescence were sequenced and 2 isolates (LCW0418.018 and LCW0418.052) were chosen for future use based on sequencing and expression data.

The specific clone pCW0432 of XTEN_AE864 was constructed by combining LCW0418.018 of XTEN_AE576 and LCW0414.002 of XTEN_AE288 using the same dimerization process as described above.

Example 6: Construction of XTEN_AM144

A collection of XTEN_AM144 segments was constructed starting from 37 different segments of XTEN_AE36, 44 segments of XTEN_AF36, and 44 segments of XTEN_AG36.

Cultures of E. coli harboring all 125 different 36-amino acid segments were mixed and plasmid was isolated. This plasmid pool was digested with BsaI/NcoI to generate the small fragment as the insert. The same plasmid pool was digested with BbsI/NcoI to generate the large fragment as the vector. The insert and vector fragments were ligated resulting in a doubling of the length and the ligation mixture was transformed into BL21Gold(DE3) cells to obtain colonies of XTEN_AM72.

This library of XTEN_AM72 segments was designated LCW0461. All clones from LCW0461 were combined and dimerized again using the same process as described above yielding library LCW0462. 1512 Isolates from library LCW0462 were screened for protein expression. Individual colonies were transferred into 96 well plates and cultured overnight as starter cultures. These starter cultures were diluted into fresh autoinduction medium and cultured for 20-30 h. Expression was measured using a fluorescence plate reader with excitation at 395 nm and emission at 510 nm. 192 isolates showed high level expression and were submitted to DNA sequencing. Most clones in library LCW0462 showed good expression and similar physicochemical properties suggesting that most combinations of XTEN_AM36 segments yield useful XTEN sequences. 30 isolates from LCW0462 were chosen as a preferred collection of XTEN_AM144 segments for the construction of multifunctional proteins that contain multiple XTEN segments. The file names of the nucleotide and amino acid constructs for these segments are listed in Table 12.

TABLE 12

DNA and amino acid sequences for AM144 segments

| Clone | Sequence Trimmed | SEQ ID NO: | Protein Sequence | SEQ ID NO: |
|---|---|---|---|---|
| LCW462_r1 | GGTACCCCGGGCAGCGGTACCGCATCTTCCTCTCCAG GTAGCTCTACCCCGTCTGGTGCTACCGGTTCCCCAGG | 517 | GTPGSGTASSSPGSST PSGATGSPGSSTPSGA | 518 |

TABLE 12-continued

DNA and amino acid sequences for AM144 segments

| Clone | Sequence Trimmed | SEQ ID NO: | Protein Sequence | SEQ ID NO: |
|---|---|---|---|---|
| | TAGCTCTACCCCGTCTGGTGCAACCGGCTCCCCAGGT<br>AGCCCGGCTGGCTCTCCTACCTCTACTGAGGAAGGTA<br>CTTCTGAAAGCGCTACTCCTGAGTCTGGTCCAGGTAC<br>CTCTACTGAACCGTCCGAAGGTAGCGCTCCAGGTTCT<br>AGCCCTTCTGCATCCACCGGTACCGGCCCAGGTTCTA<br>GCCCGTCTGCTTCTACCGGTACTGGTCAGGTGCTTCT<br>CCGGGTACTAGCTCTACTGGTTCTCCAGGTACCTCTA<br>CCGAACCGTCCGAGGGTAGCGCACCAGGTACCTCTAC<br>TGAACCGTCTGAGGGTAGCGCTCCAGGTAGCGAACC<br>GGCAACCTCCGGTTCTGAAACTCCA | | TGSPGSPAGSPTSTEE<br>GTSESATPESGPGTST<br>EPSEGSAPGSSPSAST<br>GTGPGSSPSASTGTGP<br>GASPGTSSTGSPGTST<br>EPSEGSAPGTSTEPSE<br>GSAPGSEPATSGSETP | |
| LCW462_r5 | GGTTCTACCAGCGAATCCCCTTCTGGCACTGCACCAG<br>GTTCTACTAGCGAATCCCCTTCTGGTACCGCACCAGG<br>TACTTCTCCGAGCGGCGAATCTTCTACTGCTCCAGGT<br>ACCTCTACTGAACCTTCCGAAGGCAGCGCTCCAGGTA<br>CCTCTACCGAACCGTCCGAGGGCAGCGCACCAGGTAC<br>TTCTGAAAGCGCAACCCCTGAATCCGGTCCAGGTGCA<br>TCTCCTGGTACCAGCTCTACCGGTTCTCCAGGTAGCTC<br>TACTCCTTCTGGTGCTACTGGCTCTCCAGGTGCTTCCC<br>CGGGTACCAGCTCTACCGGTTCTCCAGGTTCTACTAG<br>CGAATCTCCTTCTGGCACTGCACCAGGTTCTACCAGC<br>GAATCTCCGTCTGGCACTGCACCAGGTACCTCTACCC<br>CTGAAAGCGGTTCCGCTTCTCCA | 519 | GSTSESPSGTAPGSTS<br>ESPSGTAPGTSPSGES<br>STAPGTSTEPSEGSAP<br>GTSTEPSEGSAPGTSE<br>SATPESGPGASPGTSS<br>TGSPGSSTPSGATGSP<br>GASPGTSSTGSPGSTS<br>ESPSGTAPGSTSESPS<br>GTAPGTSTPESGSASP | 520 |
| LCW462_r9 | GGTACTTCTACCGAACCTTCCGAGGGCAGCGCACCAG<br>GTACTTCTGAAAGCGCTACCCCTGAGTCCGGCCCAGG<br>TACTTCTGAAAGCGCTACTCCTGAATCCGGTCCAGGT<br>ACCTCTACTGAACCTTCTGAGGGCAGCGCTCCAGGTA<br>CTTCTGAAAGCGCTACCCCGGAGTCCGGTCCAGGTAC<br>TTCTACTGAACCGTCCGAAGGTAGCGCACCAGGTACT<br>TCTACTGAACCTTCCGAAGGTAGCGCTCCAGGTAGCG<br>AACCTGCTACTTCTGGTTCTGAAACCCCAGGTAGCCC<br>GGCTGGCTCTCCGACCTCCACCGAGGAAGGTGCTTCT<br>CCTGGCACCAGCTCTACTGGTTCTCCAGGTTCTAGCC<br>CTTCTGCTTCTACCGGTACTGGTCCAGGTTCTAGCCCT<br>TCTGCATCCACTGGTACTGGTCCA | 521 | GTSTEPSEGSAPGTSE<br>SATPESGPGTSESATP<br>ESGPGTSTEPSEGSAP<br>GTSESATPESGPGTST<br>EPSEGSAPGTSTEPSE<br>GSAPGSEPATSGSETP<br>GSPAGSPTSTEEGASP<br>GTSSTGSPGSSPSAST<br>GTGPGSSPSASTGTGP | 522 |
| LCW462_r10 | GGTAGCGAACCGGCAACCTCTGGCTCTGAAACCCCAG<br>GTACCTCTGAAAGCGCTACTCCGGAATCTGGTCCAGG<br>TACTTCTGAAAGCGCTACTCCGGAATCCGGTCCAGGT<br>TCTACCAGCGAATCTCCTTCTGGCACCGCTCCAGGTT<br>CTACTAGCGAATCCCCGTCTGGTACCGCACCAGGTAC<br>TTCTCCTAGCGGCGAATCTTCTACCGCACCAGGTGCA<br>TCTCCGGGTACTAGCTCTACCGGTTCTCCAGGTTCTAG<br>CCCTTCTGCTTCCACTGGTACCGGCCCAGGTAGCTCT<br>ACCCCGTCTGGTGCTACTGGTTCCCCAGGTAGCTCTA<br>CTCCGTCTGGTGCAACCGGTTCCCCAGGTAGCTCTAC<br>TCCTTCTGGTGCTACTGGCTCCCCAGGTGCATCCCTG<br>GCACCAGCTCTACCGGTTCTCCA | 523 | GSEPATSGSETPGTSE<br>SATPESGPGTSESATP<br>ESGPGTSESPSGTAP<br>GSTSESPSGTAPGTSP<br>SGESSTAPGASPGTSS<br>TGSPGSSPSASTGTGP<br>GSSTPSGATGSPGSST<br>PSGATGSPGSSTPSGA<br>TGSPGASPGTSSTGSP | 524 |
| LCW462_r15 | GGTGCTTCTCCGGGCACCAGCTCTACTGGTTCTCCAG<br>GTTCTAGCCCTTCTGCATCCACCGGTACCGGTCCAGG<br>TAGCTCTACCCCTTCTGGTGCAACCGGCTCTCCAGGT<br>ACTTCTGAAAGCGCTACCCCGGAATCTGGCCCAGGTA<br>GCGAACCGGCTACTTCTGGTTCTGAAACCCCAGGTAG<br>CGAACCGGCTACTTCCGGTTCTGAAACTCCAGGTACT<br>TCTGAAAGCGCTACTCCGGAGTCCGGTCCAGGTACCT<br>CTACCGAACCGTCCGAAGGCAGCGCTCCAGGTACTTC<br>TACTGAACCTTCTGAGGGTAGCGCTCCAGGTACCTCT<br>ACCGAACCGTCCGAGGGTAGCGCACCAGGTACCTCTA<br>CTGAACCGTCTGAGGGTAGCGCTCCAGGTAGCGAACC<br>GGCAACCTCCGGTTCTGAAACTCCA | 525 | GASPGTSSTGSPGSSP<br>SASTGTGPGSSTPSGA<br>TGSPGTSESATPESGP<br>GSEPATSGSETPGSEP<br>ATSGSETPGTSESATP<br>ESGPGTSTEPSEGSAP<br>GTSTEPSEGSAPGTST<br>EPSEGSAPGTSTEPSE<br>GSAPGSEPATSGSETP | 526 |
| LCW462_r16 | GGTACCTCTACCGAACCTTCCGAAGGTAGCGCTCCAG<br>GTAGCCCGGCAGGTTCTCCTACTTCCACTGAGGAAGG<br>TACTTCTACCGAACCTTCTGAGGGTAGCGCACCAGGT<br>ACCTCTGAAAGCGCAACTCCTGAGTCTGGCCCAGGTA<br>GCGAACCTGCTACTCCGGCTCTGAGACTCCAGGTAC<br>CTCTGAAAGCGCAACCCCGGAATCTGGTCCAGGTAGC<br>CCGGCTGGCTCTCCTACCTCTACTGAGGAAGGTACTT<br>CTGAAAGCGCTACTCCTGAGTCTGGTCAGGTACCTCT<br>TACTGAACCGTCCGAAGGTAGCGCTCCAGGTAGCGA<br>ACCTGCTACTTCTGGTTCTGAAACTCCAGGTACTTCTA<br>CCGAACCGTCCGAGGGTAGCGCTCCAGGTAGCGAAC<br>CTGCTACTTCTGGTTCTGAAACTCCA | 527 | GTSTEPSEGSAPGSPA<br>GSPTSTEEGTSTEPSE<br>GSAPGTSESATPESGP<br>GSEPATSGSETPGTSE<br>SATPESGPGSPAGSPT<br>STEEGTSESATPESGP<br>GTSTEPSEGSAPGSEP<br>ATSGSETPGTSTEPSE<br>GSAPGSEPATSGSETP | 528 |

TABLE 12-continued

DNA and amino acid sequences for AM144 segments

| Clone | Sequence Trimmed | SEQ ID NO: | Protein Sequence | SEQ ID NO: |
|---|---|---|---|---|
| LCW462_r20 | GGTACTTCTACCGAACCGTCCGAAGGCAGCGCTCCAG GTACCTCTACTGAACCTTCCGAGGGCAGCGCTCCAGG TACCTCTACCGAACCTTCTGAAGGTAGCGCACCAGGT ACTTCTACCGAACCGTCCGAAGGCAGCGCTCCAGGTA CCTCTACTGAACCTTCCGAGGGCAGCGCTCCAGGTAC CTCTACCGAACCTTCTGAAGGTAGCGCACCAGGTACT TCTACCGAACCTTCCGAGGGCAGCGCACCAGGTACTT CTGAAAGCGCTACCCCTGAGTCCGGCCCAGGTACTTC TGAAAGCGCTACTCCTGAATCCGGTCCAGGTACTTCT ACTGAACCTTCCGAAGGTAGCGCTCCAGGTAGCGAAC CTGCTACTTCTGGTTCTGAAACCCCAGGTAGCCCGGC TGGCTCTCCGACCTCCACCGAGGAA | 529 | GTSTEPSEGSAPGTST EPSEGSAPGTSTEPSE GSAPGTSTEPSEGSAP GTSTEPSEGSAPGTST EPSEGSAPGTSTEPSE GSAPGTSESATPESGP GTSESATPESGPGTST EPSEGSAPGSEPATSG SETPGSPAGSPTSTEE | 530 |
| LCW462_r23 | GGTACTTCTACCGAACCGTCCGAGGGCAGCGCTCCAG GTACTTCTACTGAACCTTCTGAAGGCAGCGCTCCAGG TACTTCTACTGAACCTTCCGAAGGTAGCGCACCAGGT TCTACCAGCGAATCCCCTTCTGGTACTGCTCCAGGTTC TACCAGCGAATCCCCTTCTGGCACCGCACCAGGTACT TCTACCCCTGAAAGCGGCTCCGCTTCTCCAGGTAGCG AACCTGCAACCTCTGGCTCTGAAACCCCAGGTACCTC TGAAAGCGCTACTCCTGAATCTGGCCCAGGTACTTCT ACTGAACCGTCCGAGGGCAGCGCACCAGGTACTTCTA CTGAACCGTCTGAAGGTAGCGCACCAGGTACTTCTGA AAGCGCAACCCCGGAATCCGCCCAGGTACCTCTGA AAGCGCAACCCCGGAGTCCGCCCA | 531 | GTSTEPSEGSAPGTST EPSEGSAPGTSTEPSE GSAPGTSESPSGTAP GSTSESPSGTAPGTST PESGSASPGSEPATSG SETPGTSESATPESGP GTSTEPSEGSAPGTST EPSEGSAPGTSESATP ESGPGTSESATPESGP | 532 |
| LCW462_r24 | GGTAGCTCTACCCCTTCTGGTGCTACCGGCTCTCCAG GTTCTAGCCCGTCTGCTTCTACCGGTACCGGTCCAGG TAGCTCTACCCCTTCTGGTGCTACTGGTTCTCCAGGTA GCCCTGCTGGCTCTCCGACTTCTACTGAGGAAGGTAG CCCGGCTGGTTCTCCGACTTCTACTGAGGAAGGTACT TCTACCGAACCTTCCGAAGGTAGCGCTCCAGGTGCTT CCCCGGGCACTAGCTCTACCGGTTCTCCAGGTTCTAG CCCTTCTGCATCTACTGGTACTGGCCCAGGTACTCCG GGCAGCGGTACTGCTTCTTCCTCTCCAGGTTCTACTAG CTCTACTGCTGAATCTCCTGGCCCAGGTACTTCTCCTA GCGGTGAATCTTCTACCGCTCCAGGTACCTCTACTCC GGAAAGCGGTTCTGCATCTCCA | 533 | GSSTPSGATGSPGSSP SASTGTGPGSSTPSGA TGSPGSPAGSPTSTEE GSPAGSPTSTEEGTST EPSEGSAPGASPGTSS TGSPGSSPSASTGTGP GTPGSGTASSSPGSTS STAESPGPGTSPSGES STAPGTSTPESGSASP | 534 |
| LCW462_r27 | GGTACCTCTACTGAACCTTCTGAGGGCAGCGCTCCAG GTACTTCTGAAAGCGCTACCCCGGAGTCCGGTCCAGG TACTTCTACTGAACCGTCCGAAGGTAGCGCACCAGGT ACTTCTACTGAACCGTCTGAAGGTAGCGCACCAGGTA CTTCTGAAAGCGCAACCCCGGAATCCGCCCAGGTAC CTCTGAAAGCGCAACCCCGGAGTCCGGCCCAGGTACT CCTGGCAGCGGTACCGCTTCTTCTTCTCCAGGTGCTTC TCCTGGTACTAGCTCTACTGGTTCTCCAGGTGCTTCTC CGGGCACTAGCTCTACTGGTTCTCCAGGTAGCCCTGC TGGCTCTCCGACTTCTACTGAGGAAGGTAGCCCGGCT GGTTCTCCGACTTCTACTGAGGAAGGTACTTCTACCG AACCTTCCGAAGGTAGCGCTCCA | 535 | GTSTEPSEGSAPGTSE SATPESGPGTSTEPSE GSAPGTSTEPSEGSAP GTSESATPESGPGTSE SATPESGPGTPGSGTA SSSPGASPGTSSTGSP GASPGTSSTGSPGSPA GSPTSTEEGSPAGSPT STEEGTSTEPSEGSAP | 536 |
| LCW462_r28 | GGTAGCCCAGCAGGCTCTCCGACTTCCACTGAGGAAG GTACTTCTACTGAACCTTCCGAAGGCAGCGCACCAGG TACCTCTACTGAACCTTCTGAGGGCAGCGCTCCAGGT ACCTCTACCGAACCGTCTGAAGGTAGCGCACCAGGTA CCTCTGAAAGCGCAACTCCTGAGTCCGGTCCAGGTAC TTCTGAAAGCGCAACCCCGGAGTCTGGCCCAGGTACC CCGGGTAGCGGTACTGCTTCTTCCTCTCCAGGTAGCT CTACCCCTTCTGGTGCAACCGGCTCTCCAGGTGCTTCT CCGGGCACCAGCTCTACCGGTTCTCCAGGTACCTCTA CTGAACCTTCTGAGGGCAGCGCTCCAGGTACTTCTGA AAGCGCTACCCCGGAGTCCGGTCCAGGTACTTCTACT GAACCGTCCGAAGGTAGCGCACCA | 537 | GSPAGSPTSTEEGTST EPSEGSAPGTSTEPSE GSAPGTSTEPSEGSAP GTSESATPESGPGTSE SATPESGPGTPGSGTA SSSPGSSTPSGATGSP GASPGTSSTGSPGTST EPSEGSAPGTSESATP ESGPGTSTEPSEGSAP | 538 |
| LCW462_r38 | GGTAGCGAACCGGCAACCTCCGGCTCTGAAACTCCAG GTACTTCTGAAAGCGCTACTCCGGAATCCGGCCCAGG TAGCGAACCGGCTACTTCCGGCTCTGAAACCCCAGGT AGCTCTACCCCGTCTGGTGCAACCGGCTCCCCAGGTA CTCCTGGTAGCGGTACCGCTTCTTCTTCTCCAGGTAGC TCTACTCCGTCTGGTGCTACCGGCTCCCCAGGTGCAT CTCCTGGTACCAGCTCTACCGGTTCTCCAGGTAGCTCT | 539 | GSEPATSGSETPGTSE SATPESGPGSEPATSG SETPGSSTPSGATGSP GTPGSGTASSSPGSST PSGATGSPGASPGTSS TGSPGSSTPSGATGSP GASPGTSSTGSPGSEP | 540 |

TABLE 12-continued

DNA and amino acid sequences for AM144 segments

| Clone | Sequence Trimmed | SEQ ID NO: | Protein Sequence | SEQ ID NO: |
|---|---|---|---|---|
| | ACTCCTTCTGGTGCTACTGGCTCTCCAGGTGCTTCCCC GGGTACCAGCTCTACCGGTTCTCCAGGTAGCGAACCT GCTACTTCTGGTTCTGAAACTCCAGGTACTTCTACCG AACCGTCCGAGGGTAGCGCTCCAGGTAGCGAACCTG CTACTTCTGGTTCTGAAACTCCA | | ATSGSETPGTSTEPSE GSAPGSEPATSGSETP | |
| LCW462_r39 | GGTACCTCTACTGAACCTTCCGAAGGCAGCGCTCCAG GTACCTCTACCGAACCGTCCGAGGGCAGCGCACCAG GTACTTCTGAAAGCGCAACCCCTGAATCCGGTCCAGG TAGCCCTGCTGGCTCTCCGACTTCTACTGAGGAAGGT AGCCCGGCTGGTTCTCCGACTTCTACTGAGGAAGGTA CTTCTACCGAACCTTCCGAAGGTAGCGCTCCAGGTAG CCCGGCTGGTTCTCCGACTTCCACCGAGGAAGGTACC TCTACTGAACCTTCTGAGGGTAGCGCTCCAGGTACCT CTACTGAACCTTCCGAAGGCAGCGCTCCAGGTGCTTC CCCGGGCACCAGCTCTACTGGTTCTCCAGGTTCTAGC CCGTCTGCTTCTACTGGTACTGGTCCAGGTTCTAGCCC TTCTGCTTCCACTGGTACTGGTCCA | 541 | GTSTEPSEGSAPGTST EPSEGSAPGTSESATP ESGPGSPAGSPTSTEE GSPAGSPTSTEEGTST EPSEGSAPGSPAGSPT STEEGTSTEPSEGSAP GTSTEPSEGSAPGASP GTSSTGSPGSSPSAST GTGPGSSPSASTGTGP | 542 |
| LCW462_r41 | GGTAGCTCTACCCCGTCTGGTGCTACCGGTTCCCCAG GTGCTTCTCCTGGTACTGCTACCGGTTCTCCAGGT AGCTCTACCCCGTCTGGTGCTACTGGCTCTCCAGGTA GCCCTGCTGGCTCTCCAACCTCCACCGAAGAAGGTAC CTCTGAAAGCGCAACCCCTGAATCCGGCCCAGGTAGC GAACCGGCAACCTCCGGTTCTGAAACCCAGGTGCAT CTCCTGGTACTAGCTCTACTGGTTCTCCAGGTAGCTCT ACTCCGTCTGGTGCAACCGGCTCTCCAGGTTCTAGCC CTTCTGCATCTACCGGTACTGGTCCAGGTTCTACCAG CGAATCCCCTTCTGGTACTGCTCCAGGTTCTACCAGC GAATCCCCTTCTGGCACCGCACCAGGTACTTCTACCC CTGAAAGCGGCTCCGCTTCTCCA | 543 | GSSTPSGATGSPGASP GTSSTGSPGSSPSGA TGSPGSPAGSPTSTEE GTSESATPESGPGSEP ATSGSETPGASPGTSS TGSPGSSTPSGATGSP GSSPSASTGTGPGSTS ESPSGTAPGSTSESPS GTAPGTSTPESGSASP | 544 |
| LCW462_r42 | GGTTCTACCAGCGAATCTCCTTCTGGCACCGCTCCAG GTTCTACTAGCGAATCCCCGTCTGGTACCGCACCAGG TACTTCTCCTAGCGGCGAATCTTCTACCGCACCAGGT ACCTCTGAAAGCGCTACTCCGGAGTCTGGCCCAGGTA CCTCTACTGAACCGTCTGAGGGTAGCGCTCCAGGTAC TTCTGAACCGTCCGAAGGTAGCGCACCAGGTACC TCTACTGAACCTTCTGAGGGCAGCGCTCCAGGTACTT CTGAAAGCGCTACCCCGGAGTCCGGTCCAGGTACTTC TACTGAACCGTCCGAAGGTAGCGCACCAGGTAGCTCT ACCCCGTCTGGTGCTACCGGTTCCCAGGTGCTTCTCC TGGTACTAGCTCTACCGGTTCTCCAGGTAGCTCTACC CCGTCTGGTGCTACTGGCTCTCCA | 545 | GSTSESPSGTAPGSTS ESPSGTAPGTSPSGES STAPGTSESATPESGP GTSTEPSEGSAPGTST EPSEGSAPGTSTEPSE GSAPGTSESATPESGP GTSTEPSEGSAPGTST PSGATGSPGASPGTSS TGSPGSSTPSGATGSP | 546 |
| LCW462_r43 | GGTTCTACTAGCTCTACTGCAGAATCTCCGGGCCCAG GTACCTCTCCTAGCGGTGAATCTTCTACCGCTCCAGG TACTTCTCCGAGCGGTGAATCTTCTACCGCTCCAGGTT CTACTAGCTCTACCGCTGAATCTCCGGGTCCAGGTTC TACCAGCTCTACTGCAGAATCTCCTGGCCCAGGTACT TCTACTCCGGAAAGCGGTTCCGCTTCTCCAGGTACTT CTCCTAGCGGTGAATCTTCTACCGCTCCAGGTTCTACC AGCTCTACTGCTGAATCTCCTGGCCCAGGTACTTCTA CCCCGGAAAGCGGCTCCGCTTCTCCAGGTTCTACCAG CTCTACCGCTGAATCTCCTGGCCCAGGTTCTACTAGC GAATCTCCGTCTGGCACCGCACCAGGTACTTCCCCTA GCGGTGAATCTTCTACTGCACCA | 547 | GSTSSTAESPGPGTSP SGESSTAPGTSPSGES STAPGSTSSTAESPGP GSTSSTAESPGPGTST PESGSASPGTSPSGES STAPGSTSSTAESPGP GTSTPESGSASPGSTS STAESPGPGSTSESPS GTAPGTSPSGESSTAP | 548 |
| LCW462_r45 | GGTACCTCTACTCCGGAAAGCGGTTCCGCATCTCCAG GTTCTACCAGCGAATCCCCGTCTGGCACCGCACCAGG TTCTACTAGCTCTACTGCTGAATCTCCGGGCCCAGGT ACCTCTACTGAACCTTCCGAAGGCAGCGCTCCAGGTA CCTCTACCGAACCGTCCGAGGGCAGCGCACCAGGTAC TTCTGAAAGCGCAACCCCTGAATCCGGTCCAGGTACC TCTGAAAGCGCTACTCCGGAGTCTGGCCCAGGTACCT CTACTGAACCGTCTGAGGGTAGCGCTCCAGGTACTTC TACTGAACCGTCCGAAGGTAGCGCACCAGGTACTTCT GAAAGCGCTACTCCGGAGTCCGGTCCAGGTACCTCTA CCGAACCGTCCGAAGGCAGCGCTCCAGGTACTTCTAC TGAACCTTCTGAGGGTAGCGCTCCC | 549 | GTSTPESGSASPGSTS ESPSGTAPGSTSSTAE SPGPGTSTEPSEGSAP GTSTEPSEGSAPGTSE SATPESGPGTSESATP ESGPGTSTEPSEGSAP GTSTEPSEGSAPGTSE SATPESGPGTSTEPSE GSAPGTSTEPSEGSAP | 550 |
| LCW462_r47 | GGTACCTCTACCGAACCGTCCGAGGGTAGCGCACCAG GTACCTCTACTGAACCGTCTGAGGGTAGCGCTCCAGG TAGCGAACCGGCAACCTCCGGTTCTGAAACTCCAGGT ACTTCTACTGAACCGTCTGAGGGTAGCGCACCAGGTA CTTCTGAAAGCGCAACCCCGGAATCCGGCCCAGGTAC | 551 | GTSTEPSEGSAPGTST EPSEGSAPGSEPATSG SETPGTSTEPSEGSAP GTSESATPESGPGTSE SATPESGPGASPGTSS | 552 |

TABLE 12-continued

DNA and amino acid sequences for AM144 segments

| Clone | Sequence Trimmed | SEQ ID NO: | Protein Sequence | SEQ ID NO: |
|---|---|---|---|---|
| | CTCTGAAAGCGCAACCCCGGAGTCCGGCCCAGGTGC<br>ATCTCCGGGTACTAGCTCTACCGGTTCTCCAGGTTCTA<br>GCCCTTCTGCTTCCACTGGTACCGGCCCAGGTAGCTC<br>TACCCCGTCTGGTGCTACTGGTTCCCCAGGTAGCTCT<br>ACTCCGTCTGGTGCAACCGGTTCCCCCAGGTAGCTCTA<br>CTCCTTCTGGTGCTACTGGCTCCCCAGGTGCATCCCCT<br>GGCACCAGCTCTACCGGTTCTCCA | | TGSPGSSPSASTGTGP<br>GSSTPSGATGSPGSST<br>PSGATGSPGSSTPSGA<br>TGSPGASPGTSSTGSP | |
| LCW462_r54 | GGTAGCGAACCGGCAACCTCTGGCTCTGAAACTCCAG<br>GTAGCGAACCTGCAACCTCCGGCTCTGAAACCCCAGG<br>TACTTCTACTGAACCTTCTGAGGGCAGCGCACCAGGT<br>AGCGAACCTGCAACCTCTGGCTCTGAAACCCCAGGTA<br>CCTCTGAAAGCGCTACCTCCGAATCTGGCCCAGGTAC<br>TTCTACTGAACCGTCCGAGGGCAGCGCACCAGGTAGC<br>TCTACTCCGTCTGGTGCTACCGGCTCTCCAGGTAGCTC<br>TACCCCTTCTGGTGCAACCGGCTCCCCAGGTGCTTCTC<br>CGGGTACCAGCTCTACTGGTTCTCCAGGTAGCTCTAC<br>CCCGTCTGGTGCTACCGGTTCCCCAGGTGCTTCTCCTG<br>GTACTAGCTCTACCGGTTCTCCAGGTAGCTCTACCCC<br>GTCTGGTGCTACTGGCTCTCCA | 553 | GSEPATSGSETPGSEP<br>ATSGSETPGTSTEPSE<br>GSAPGSEPATSGSETP<br>GTSESATPESGPGTST<br>EPSEGSAPGSSTPSGA<br>TGSPGSSTPSGATGSP<br>GASPGTSSTGSPGSST<br>PSGATGSPGASPGTSS<br>TGSPGSSTPSGATGSP | 554 |
| LCW462_r55 | GGTACTTCTACCGAACCGTCCGAGGGCAGCGCTCCAG<br>GTACTTCTACTGAACCTTCTGAAGGCAGCGCTCCAGG<br>TACTTCTACTGAACCTTCCGAAGGTAGCGCACCAGGT<br>ACTTCTGAAAGCGCTACTCCGGAGTCCGGTCCAGGTA<br>CCTCTACCGAACCGTCCGAAGGCAGCGCTCCAGGTAC<br>TTCTACTGAACCTTCTGAGGGTAGCGCTCCAGGTTCT<br>ACTAGCGAATCTCCGTCTGGCACTGCTCCAGGTACTT<br>CTCCTAGCGGTGAATCTTCTACCGCTCCAGGTACTTCC<br>CCTAGCGGCGAATCTTCTACCGCTCCAGGTAGCCCGG<br>CTGGCTCTCCTACCTCTACTGAGGAAGGTACTTCTGA<br>AAGCGCTACTCCTGAGTCTGGTCCAGGTACCTCTACT<br>GAACCGTCCGAAGGTAGCGCTCCA | 555 | GTSTEPSEGSAPGTST<br>EPSEGSAPGTSTEPSE<br>GSAPGTSESATPESGP<br>GTSTEPSEGSAPGTST<br>EPSEGSAPGSTSESPS<br>GTAPGTSPSGESSTAP<br>GTSPSGESSTAPGSPA<br>GSPTSTEEGTSESATP<br>ESGPGTSTEPSEGSAP | 556 |
| LCW462_r57 | GGTACTTCTACTGAACCTTCCGAAGGTAGCGCTCCAG<br>GTAGCGAACCTGCTACTTCTGGTTCTGAAACCCCAGG<br>TAGCCCGGCTGGCTCTCCGACCTCCACCGAGGAAGGT<br>AGCCCGGCAGGCTCTCCGACCTCTACTGAGGAAGGTA<br>CTTCTGAAAGCGCAACCCCGGAGTCCGGCCCAGGTAC<br>CTCTACCGAACCGTCTGAGGGCAGCGCACCAGGTACC<br>TCTACTGAACCTTCCGAAGGCAGCGCTCCAGGTACCT<br>CTACCGAACCGTCCGAGGGCAGCGCACCAGGTACTTC<br>TGAAAGCGCAACCCCTGAATCCGGTCCAGGTAGCTCT<br>ACTCCGTCTGGTGCAACCGGCTCCCCAGGTTCTAGCC<br>CGTCTGCTTCCACTGGTACTGGCCCAGGTGCTTCCCC<br>GGGCACCAGCTCTACTGGTTCTCCA | 557 | GTSTEPSEGSAPGSEP<br>ATSGSETPGSPAGSPT<br>STEEGSPAGSPTSTEE<br>GTSESATPESGPGTST<br>EPSEGSAPGTSTEPSE<br>GSAPGTSTEPSEGSAP<br>GTSESATPESGPGSST<br>PSGATGSPGSSPSAST<br>GTGPGASPGTSSTGSP | 558 |
| LCW462_r61 | GGTAGCGAACCGGCTACTTCCGGCTCTGAGACTCCAG<br>GTAGCCCTGCTGGCTCTCCGACCTCTACCGAAGAAGG<br>TACCTCTGAAAGCGCTACCCCTGAGTCTGGCCCAGGT<br>ACCTCTACTGAACCTTCCGAAGGCAGCGCTCCAGGTA<br>CCTCTACCGAACCGTCCGAGGGCAGCGCACCAGGTAC<br>TTCTGAAAGCGCAACCCCTGAATCCGGTCCAGGTACC<br>TCTACTCCGGAAAGCGGTTCCGCATCTCCAGGTTCTA<br>CCAGCGAATCCCCGTCTGGCACCGCACCAGGTTCTAC<br>TAGCTCTACTGCTGAATCTCCGGGCCCAGGTACTTCT<br>GAAAGCGCTACTCCGGAGTCCGGTCCAGGTACCTCTA<br>CCGAACCGTCCGAAGGCAGCGCTCCAGGTACTTCTAC<br>TGAACCTTCTGAGGGTAGCGCTCCA | 559 | GSEPATSGSETPGSPA<br>GSPTSTEEGTSESATP<br>ESGPGTSTEPSEGSAP<br>GTSTEPSEGSAPGTSE<br>SATPESGPGTSTPESG<br>SASPGSTSESPSGTAP<br>GSTSSTAESPGPGTSE<br>SATPESGPGTSTEPSE<br>GSAPGTSTEPSEGSAP | 560 |
| LCW462_r64 | GGTACTTCTACCGAACCGTCCGAGGGCAGCGCTCCAG<br>GTACTTCTACTGAACCTTCTGAAGGCAGCGCTCCAGG<br>TACTTCTACTGAACCTTCCGAAGGTAGCGCACCAGGT<br>ACCTCTACCGAACCGTCTGAAGGTAGCGCACCAGGTA<br>CCTCTGAAAGCGCAACTCCTGAGTCCGGTCCAGGTAC<br>TTCTGAAAGCGCAACCCCGGAGTCTGGCCCAGGTACT<br>CCTGGCAGCGGTACCGCATCTTCCTCTCCAGGTAGCT<br>CTACTCCGTCTGGTGCAACTGGTTCCCCAGGTGCTTCT<br>CCGGGTACCAGCTCTACCGGTTCTCCAGGTTCCACCA<br>GCTCTACTGCTGAATCTCCTGGTCCAGGTACCTCTCCT<br>AGCGGTGAATCTTCTACTGCTCCAGGTACTTCTACTCC<br>TGAAAGCGGCTCTGCTTCTCCA | 561 | GTSTEPSEGSAPGTST<br>EPSEGSAPGTSTEPSE<br>GSAPGTSESATPESGP<br>GTSESATPESGPGTSE<br>SATPESGPGTPGSGTA<br>SSSPGSSTPSGATGSP<br>GASPGTSSTGSPGSTS<br>STAESPGPGTSPSGES<br>STAPGTSTPESGSASP | 562 |
| LCW462_r67 | GGTAGCCCGGCAGGCTCTCCGACCTCTACTGAGGAAG<br>GTACTTCTGAAAGCGCAACCCCGGAGTCCGGCCCAGG<br>TACCTCTACCGAACCGTCTGAGGGCAGCGCACCAGGT | 563 | GSPAGSPTSTEEGTSE<br>SATPESGPGTSTEPSE<br>GSAPGTSESATPESGP | 564 |

TABLE 12-continued

DNA and amino acid sequences for AM144 segments

| Clone | Sequence Trimmed | SEQ ID NO: | Protein Sequence | SEQ ID NO: |
|---|---|---|---|---|
| | ACTTCTGAAAGCGCAACCCCTGAATCCGGTCCAGGTA<br>GCGAACCGGCTACTTCTGGCTCTGAGACTCCAGGTAC<br>TTCTACCGAACCGTCCGAAGGTAGCGCACCAGGTAGC<br>CCGGCTGGTTCTCCGACTTCCACCGAGGAAGGTACCT<br>CTACTGAACCTTCTGAGGGTAGCGCTCCAGGTACCTC<br>TACTGAACCTTCCGAAGGCAGCGCTCCAGGTACTTCT<br>ACCGAACCGTCCGAGGGCAGCGCTCCAGGTACTTCTA<br>CTGAACCTTCTGAAGGCAGCGCTCCAGGTACTTCTAC<br>TGAACCTTCCGAAGGTAGCGCACCA | | GSEPATSGSETPGTST<br>EPSEGSAPGSPAGSPT<br>STEEGTSTEPSEGSAP<br>GTSTEPSEGSAPGTST<br>EPSEGSAPGTSTEPSE<br>GSAPGTSTEPSEGSAP | |
| LCW462_r69 | GGTACTTCTCCGAGCGGTGAATCTTCTACCGCACCAG<br>GTTCTACTAGCTCTACCGCTGAATCTCCGGGCCCAGG<br>TACTTCTCCGAGCGGTGAATCTTCTACTGCTCCAGGT<br>ACCTCTGAAAGCGCTACTCCGGAGTCTGGCCCAGGTA<br>CCTCTACTGAACCGTCTGAGGGTAGCGCTCCAGGTAC<br>TTCTACTGAACCGTCCGAAGGTAGCGCACCAGGTTCT<br>AGCCCTTCTGCATCTACTGGTACTGGCCCAGGTAGCT<br>CTACTCCTTCTGGTGCTACCGGCTCTCCAGGTGCTTCT<br>CCGGGTACTAGCTCTACCGGTTCTCCAGGTACTTCTA<br>CTCCGGAAAGCGGTTCCGCATCTCCAGGTACTTCTCC<br>TAGCGGTGAATCTTCTACTGCTCCAGGTACCTCTCCTA<br>GCGGCGAATCTTCTACTGCTCCA | 565 | GTSPSGESSTAPGSTS<br>STAESPGPGTSPSGES<br>STAPGTSESATPESGP<br>GTSTEPSEGSAPGTST<br>EPSEGSAPGSSPSAST<br>GTGPGSSTPSGATGSP<br>GASPGTSSTGSPGSTP<br>PESGSASPGTSPSGES<br>STAPGTSPSGESSTAP | 566 |
| LCW462_r70 | GGTACCTCTGAAAGCGCTACTCCGGAGTCTGGCCCAG<br>GTACCTCTACTGAACCGTCTGAGGGTAGCGCTCCAGG<br>TACTTCTACTGAACCGTCCGAAGGTAGCGCACCAGGT<br>AGCCCTGCTGGCTCTCCGACTTCTACTGAGGAAGGTA<br>GCCCGGCTGGTTCTCCGACTTCTACTGAGGAAGGTAC<br>TTCTACCGAACCTTCCGAAGGTAGCGCTCCAGGTTCT<br>AGCCCTTCTGCTTCCACCGGTACTGGCCCAGGTAGCT<br>CTACCCCTTCTGGTGCTACCGGCTCCCCAGGTAGCTCT<br>ACTCCTTCTGGTGCAACTGGCTCTCCAGGTAGCGAAC<br>CGGCAACTTCCGGCTCTGAAACCCCAGGTACTTCTGA<br>AAGCGCTACTCCTGAGTCTGGCCCAGGTAGCGAACCT<br>GCTACCTCTGGCTCTGAAACCCCA | 567 | GTSESATPESGPGTST<br>EPSEGSAPGTSTEPSE<br>GSAPGSPAGSPTSTEE<br>GSPAGSPTSTEEGTST<br>EPSEGSAPGSSPSAST<br>GTGPGSSTPSGATGSP<br>GSSTPSGATGSPGSEP<br>ATSGSETPGTSESATP<br>ESGPGSEPATSGSETP | 568 |
| LCW462_r72 | GGTACTTCTACCGAACCGTCCGAAGGCAGCGCTCCAG<br>GTACCTCTACTGAACCTTCTGAGGGCAGCGCTCCAGG<br>TACCTCTACCGAACCTTCTGAAGGTAGCGCACCAGGT<br>AGCTCTACCCCGTCTGGTGCTACCGGTTCCCCAGGTG<br>CTTCTCCTGGTACTAGCTCTACCGGTTCTCCAGGTAGC<br>TCTACCCCGTCTGGTGCTACTGGCTCTCCAGGTACTTC<br>TGAAAGCGCAACCCCTGAATCCGGTCCAGGTAGCGA<br>ACCGGCTACTTCTGGCTCTGAGACTCCAGGTACTTCT<br>ACCGAACCGTCCGAAGGTAGCGCACCAGGTTCTACTA<br>GCGAATCTCCTTCTGGCACTGCACCAGGTTCTACCAG<br>CGAATCTCCGTCTGGCACTGCACCAGGTACCTCTACC<br>CCTGAAAGCGGTTCCGCTTCTCCA | 569 | GTSTEPSEGSAPGTST<br>EPSEGSAPGTSTEPSE<br>GSAPGSSTPSGATGSP<br>GASPGTSSTGSPGSST<br>PSGATGSPGTSESATP<br>ESGPGSEPATSGSETP<br>GTSTEPSEGSAPGSTS<br>ESPSGTAPGSTSESPS<br>GTAPGTSTPESGSASP | 570 |
| LCW462_r73 | GGTACCTCTACTCCTGAAAGCGGTTCTGCATCTCCAG<br>GTTCCACTAGCTCTACCGCAGAATCTCCGGGCCCAGG<br>TTCTACTAGCTCTACTGCTGAATCTCCTGGCCCAGGTT<br>CTAGCCCTTCTGCATCTGGTACTGGCCCAGGTAG<br>CTCTACTCCTTCTGGTGCTACCGGCTCTCCAGGTGCTT<br>CTCCGGGTACTAGCTCTACCGGTTCTCCAGGTAGCGA<br>ACCGGCAACCTCCGGCTCTGAAACCCCAGGTACCTCT<br>GAAAGCGCTACTCCTGAATCCGCCCAGGTAGCCCGG<br>CAGGTTCTCCGACTTCCACTGAGGAAGGTTCTACTAG<br>CGAATCTCCTTCTGGCACTGCACCAGGTTCTACCAGC<br>GAATCTCCGTCTGGCACTGCACCAGGTACCTCTACCC<br>CTGAAAGCGGTTCCGCTTCTCCC | 571 | GTSTPESGSASPGSTS<br>STAESPGPGTSSSTAE<br>SPGPGSSPASTGTGP<br>GSSTPSGATGSPGASP<br>GTSSTGSPGSEPATSG<br>SETPGTSESATPESGP<br>GSPAGSPTSTEEGSTS<br>ESPSGTAPGSTSESPS<br>GTAPGTSTPESGSASP | 572 |
| LCW462_r78 | GGTAGCCCGGCTGGCTCTCCTACCTCTACTGAGGAAG<br>GTACTTCTGAAAGCGCTACTCCTGAGTCTGGTCCAGG<br>TACCTCTACTGAACCGTCCGAAGGTAGCGCTCCAGGT<br>TCTACCAGCGAATCTCCTTCTGGCACCGCTCCAGGTT<br>CTACTAGCGAATCCCCGTCTGGTACCGCACCAGGTAC<br>TTCTCCTAGCGGCGAATCTTCTACCGCACCAGGTACC<br>TCTACCGAACCTTCCGAAGGTAGCGCTCCAGGTAGCC<br>CGGCAGGTTCTCCTACTTCCACTGAGGAAGGTACTTC<br>TACCGAACCTTCTGAGGGTAGCGCACCAGGTAGCGA<br>ACCTGCAACCTCTGGCTCTGAAACCCCAGGTACCTCT<br>GAAAGCGCTACTCCTGAATCTGGCCCAGGTACTTCTA<br>CTGAACCGTCCGAGGGCAGCGCACCA | 573 | GSPAGSPTSTEEGTSE<br>SATPESGPGTSTEPSE<br>GSAPGSTSESPSGTAP<br>GSTSESPSGTAPGTSP<br>SGESSTAPGTSTEPSE<br>GSAPGSPAGSPTSTEE<br>GTSTEPSEGSAPGSEP<br>ATSGSETPGTSESATP<br>ESGPGTSTEPSEGSAP | 574 |

TABLE 12-continued

DNA and amino acid sequences for AM144 segments

| Clone | Sequence Trimmed | SEQ ID NO: | Protein Sequence | SEQ ID NO: |
|---|---|---|---|---|
| LCW462_r79 | GGTACCTCTACCGAACCTTCCGAAGGTAGCGCTCCAG GTAGCCCGGCAGGTTCTCCTACTTCCACTGAGGAAGG TACTTCTACCGAACCTTCTGAGGGTAGCGCACCAGGT ACCTCCCCTAGCGGCGAATCTTCTACTGCTCCAGGTA CCTCTCCTAGCGGCGAATCTTCTACCGCTCCAGGTAC CTCCCCTAGCGGTGAATCTTCTACCGCACCAGGTTCT ACCAGCGAATCCCCTTCTGGTACTGCTCCAGGTTCTA CCAGCGAATCCCCTTCTGGCACCGCACCAGGTACTTC TACCCCTGAAAGCGGCTCCGCTTCTCCAGGTAGCGAA CCTGCAACCTCTGGCTCTGAAACCCCAGGTACCTCTG AAAGCGCTACTCCTGAATCTGGCCCAGGTACTTCTAC TGAACCGTCCGAGGGCAGCGCACCA | 575 | GTSTEPSEGSAPGSPA GSPTSTEEGTSTEPSE GSAPGTSPSGESSTAP GTSPSGESSTAPGTSP SGESSTAPGSTSESPS GTAPGSTSESPSGTAP GTSTPESGSASPGSEP ATSGSETPGTSESATP ESGPGTSTEPSEGSAP | 576 |
| LCW462_r87 | GGTAGCGAACCGGCAACCTCTGGCTCTGAAACCCCAG GTACCTCTGAAAGCGCTACTCCGGAATCTGGTCCAGG TACTTCTGAAAGCGCTACTCCGGAATCCGGTCCAGGT ACTTCTCCGAGCGGTGAATCTTCTACCGCACCAGGTT CTACTAGCTCTACCGCTGAATCTCCGGGCCCAGGTAC TTCTCCGAGCGGTGAATCTTCTACTGCTCCAGGTTCTA CTAGCGAATCCCCGTCTGGTACTGCTCCAGGTACTTC CCCTAGCGGTGAATCTTCTACTGCTCCAGGTTCTACC AGCTCTACCGCAGAATCTCCGGGTCCAGGTAGCTCTA CTCCGTCTGGTGCAACCGGTTCCCCAGGTAGCTCTAC CCCTTCTGGTGCAACCGGCTCCCCAGGTAGCTCTACC CCTTCTGGTGCAAACTGGCTCTCC | 577 | GSEPATSGSETPGTSE SATPESGPGTSESATP ESGPGTSPSGESSTAP GSTSSTAESPGPGTSP SGESSTAPGSTSESPS GTAPGTSPSGESSTAP GSTSSTAESPGPGSST PSGATGSPGSSTPSGA TGSPGSSTPSGANWL S | 578 |
| LCW462_r88 | GGTAGCCCTGCTGGCTCTCCGACTTCTACTGAGGAAG GTAGCCCGGCTGGTTCTCCGACTTCTACTGAGGAAGG TACTTCTACCGAACCTTCCGAAGGTAGCGCTCCAGGT ACCTCTACTGAACCTTCCGAAGGCAGCGCTCCAGGTA CCTCTACCGAACCGTCCGAGGGCAGCGCACCAGGTAC TTCTGAAAGCGCAACCCCTGAATCCGGTCCAGGTGCA TCTCCTGGTACCAGCTCTACCGGTTCTCCAGGTAGCTC TACTCCTTCTGGTGCTACTGGCTCTCCAGGTGCTTCCC CGGGTACCAGCTCTACCGGTTCTCCAGGTAGCTCTAC CCCGTCTGGTGCTACTGGTTCTCCAGGTACTCCGGGC AGCGGTACTGCTTCTTCCTCTCCAGGTAGCTCTACCCC TTCTGGTGCTACTGGCTCTCCA | 579 | GSPAGSPTSTEEGSPA GSPTSTEEGTSTEPSE GSAPGTSTEPSEGSAP GTSTEPSEGSAPGTSE SATPESGPGASPGTSS TGSPGSSTPSGATGSP GASPGTSSTGSPGSST PSGATGSPGTPGSGT ASSSPGSSTPSGATGS P | 580 |
| LCW462_r89 | GGTAGCTCTACCCCGTCTGGTGCTACTGGTTCTCCAG GTACTCCGGGCAGCGGTACTGCTTCTTCCTCTCCAGG TAGCTCTACCCCTTCTGGTGCTACTGGCTCTCCAGGTA GCCCGGCTGGCTCTCCTACCTCTACTGAGGAAGGTAC TTCTGAAAGCGCTACTCCTGAGTCTGGTCCAGGTACC TCTACTGAACCGTCCGAAGGTAGCGCTCCAGGTACCT CTGAAAGCGCAACTCCTGAGTCTGGCCCAGGTAGCGA ACCTGCTACCTCCGGCTCTGAGACTCCAGGTACCTCT GAAAGCGCAACCCCGGAATCTGGTCCAGGTACTTCTA CTGAACCGTCTGAAGGTAGCGCACCAGGTACTTCTGA AAGCGCAACCCCGGAATCCGGCCCAGGTACCTCTGA AAGCGCAACCCCGGAGTCCGGCCCA | 581 | GSSTPSGATGSPGTPG SGTASSSPGSSTPSGA TGSPGSPAGSPTSTEE GTSESATPESGPGTST EPSEGSAPGTSESATP ESGPGSEPATSGSETP GTSESATPESGPGTST EPSEGSAPGTSESATP ESGPGTSESATPESGP | 582 |

Example 7: Construction of XTEN_AM288

The entire library LCW0462 was dimerized as described in Example 6 resulting in a library of XTEN_AM288 clones designated LCW0463. 1512 isolates from library LCW0463 were screened using the protocol described in Example 6. 176 highly expressing clones were sequenced and 40 preferred XTEN_AM288 segments were chosen for the construction of multifunctional proteins that contain multiple XTEN segments with 288 amino acid residues.

Example 8: Construction of XTEN_AM432

We generated a library of XTEN_AM432 segments by recombining segments from library LCW0462 of XTEN_AM144 segments and segments from library LCW0463 of XTEN_AM288 segments. This new library of XTEN_AM432 segment was designated LCW0464. Plasmid was isolated from cultures of E. coli harboring LCW0462 and LCW0463, respectively. 1512 isolates from library LCW0464 were screened using the protocol described in Example 6. 176 highly expressing clones were sequenced and 39 preferred XTEN_AM432 segment were chosen for the construction of longer XTENs and for the construction of multifunctional proteins that contain multiple XTEN segments with 432 amino acid residues.

In parallel we constructed library LMS0100 of XTEN_AM432 segments using preferred segments of XTEN_AM144 and XTEN_AM288. Screening of this library yielded 4 isolates that were selected for further construction.

Example 9: Construction of XTEN_AM875

The stuffer vector pCW0359 was digested with BsaI and KpnI to remove the stuffer segment and the resulting vector fragment was isolated by agarose gel purification.

We annealed the phosphorylated oligonucleotide BsaI-AscI-KpnIforP: AGGTGCAAGCGCAAGCGGCGCGC-CAAGCACGGGAGGTTCGTCTTCACTCGAGGGTAC (SEQ ID NO: 583) and the non-phosphorylated oligonucleotide BsaI-AscI-KpnIrev: CCTCGAGTGAAGACGAAC-CTCCCGTGCTTGGCGCGCCGCTTGCGCTTGC (SEQ ID NO: 584) for introducing the sequencing island A (SI-A) which encodes amino acids GASASGAPSTG (SEQ ID NO: 585) and has the restriction enzyme AscI recognition nucleotide sequence GGCGCGCC inside. The annealed oligonucleotide pairs were ligated with BsaI and KpnI digested stuffer vector pCW0359 prepared above to yield pCW0466 containing SI-A. We then generated a library of XTEN_AM443 segments by recombining 43 preferred XTEN_AM432 segments from Example 8 and SI-A segments from pCW0466 at C-terminus using the same dimerization process described in Example 5. This new library of XTEN_AM443 segments was designated LCW0479.

We generated a library of XTEN_AM875 segments by recombining segments from library LCW0479 of XTEN_AM443 segments and 43 preferred XTEN_AM432 segments from Example 8 using the same dimerization process described in Example 5. This new library of XTEN_AM875 segment was designated LCW0481.

Example 10: Construction of XTEN_AM1318

We annealed the phosphorylated oligonucleotide BsaI-FseI-KpnIforP: AGGTCCAGAACCAACGGGGCCGGC-CCCAAGCGGAGGTTCGTCTTCACTCGAGGGTAC (SEQ ID NO: 586) and the non-phosphorylated oligonucleotide BsaI-FseI-KpnIrev: CCTCGAGTGAAGACGAAC-CTCCGCTTGGGGCCGGCCCCGTTGGTTCTGG (SEQ ID NO: 587) for introducing the sequencing island B (SI-B) which encodes amino acids GPEPTGPAPSG (SEQ ID NO: 588) and has the restriction enzyme FseI recognition nucleotide sequence GGCCGGCC inside. The annealed oligonucleotide pairs were ligated with BsaI and KpnI digested stuffer vector pCW0359 as used in Example 9 to yield pCW0467 containing SI-B. We then generated a library of XTEN_AM443 segments by recombining 43 preferred XTEN_AM432 segments from Example 8 and SI-B segments from pCW0467 at C-terminus using the same dimerization process described in Example 5. This new library of XTEN_AM443 segments was designated LCW0480.

We generated a library of XTEN_AM1318 segments by recombining segments from library LCW0480 of XTEN_AM443 segments and segments from library LCW0481 of XTEN_AM875 segments using the same dimerization process as in Example 5. This new library of XTEN_AM1318 segment was designated LCW0487.

Example 11: Construction of XTEN_AD864

Using the several consecutive rounds of dimerization, we assembled a collection of XTEN_AD864 sequences starting from segments of XTEN_AD36 listed in Example 1. These sequences were assembled as described in Example 5. Several isolates from XTEN_AD864 were evaluated and found to show good expression and excellent solubility under physiological conditions. One intermediate construct of XTEN_AD576 was sequenced. This clone was evaluated in a PK experiment in cynomolgus monkeys and a half-life of about 20 h was measured.

Example 12: Construction of XTEN_AF864

Using the several consecutive rounds of dimerization, we assembled a collection of XTEN_AF864 sequences starting from segments of XTEN_AF36 listed in Example 3. These sequences were assembled as described in Example 5. Several isolates from XTEN_AF864 were evaluated and found to show good expression and excellent solubility under physiological conditions. One intermediate construct of XTEN_AF540 was sequenced. This clone was evaluated in a PK experiment in cynomolgus monkeys and a half-life of about 20 h was measured. A full length clone of XTEN_AF864 had excellent solubility and showed half-life exceeding 60 h in cynomolgus monkeys. A second set of XTEN_AF sequences was assembled including a sequencing island as described in Example 9.

Example 13: Construction of XTEN_AG864

Using the several consecutive rounds of dimerization, we assembled a collection of XTEN_AG864 sequences starting from segments of XTEN_AD36 listed in Example 1. These sequences were assembled as described in Example 5. Several isolates from XTEN_AG864 were evaluated and found to show good expression and excellent solubility under physiological conditions. A full-length clone of XTEN_AG864 had excellent solubility and showed half-life exceeding 60 h in cynomolgus monkeys.

Example 14: Construction of N-Terminal Extensions of XTEN-Construction and Screening of 12mer Addition Libraries This example details a step in the optimization of the N-terminus of the XTEN protein to promote the initiation of translation to allow for expression of XTEN fusions at the N-terminus of fusion proteins without the presence of a helper domain. Historically expression of proteins with XTEN at the N-terminus was poor, yielding values that would essentially undetectable in the GFP fluorescence assay (<25% of the expression with the N-terminal CBD helper domain) To create diversity at the codon level, seven amino acid sequences were selected and prepared with a diversity of codons. Seven pairs of oligonucleotides encoding 12 amino acids with codon diversities were designed, annealed and ligated into the NdeI/BsaI restriction enzyme digested stuffer vector pCW0551 (Stuffer-XTEN_AM875-GFP), and transformed into E. coli BL21Gold(DE3) competent cells to obtain colonies of seven libraries. The resulting clones have N-terminal XTEN 12mers fused in-frame to XTEN_AM875-GFP to allow use of GFP fluorescence for screening the expression. Individual colonies from the seven created libraries were picked and grown overnight to saturation in 500 µl of super broth media in a 96 deep well plate. The number of colonies picked ranged from approximately half to a third of the theoretical diversity of the library (see Table 13).

TABLE 13

Theoretical Diversity and Sampling Numbers for 12mer Addition Libraries. The amino acid residues with randomized codons are underlined.

| Library | Motif Family | Amino Acid Sequence | SEQ ID NO: | Theoretical Diversity | Number screened |
|---|---|---|---|---|---|
| LCW546 | AE12 | MA<u>SPAG</u>S<u>PTS</u>TEE | 589 | 572 | 2 plates (168) |
| LCW547 | AE12 | MA<u>TSES</u>A<u>TPES</u>GP | 590 | 1536 | 5 plates (420) |
| LCW548 | AF12 | MA<u>TSP</u>S<u>GES</u>STAP | 591 | 192 | 2 plates (168) |
| LCW549 | AF12 | ME<u>STSS</u>TAE<u>S</u>PGP | 592 | 384 | 2 plates (168) |
| LCW552 | AG12 | MA<u>SST</u>P<u>SGA</u>T<u>GS</u>P | 593 | 384 | 2 plates (168) |
| LCW553 | AG12 | ME<u>ASPGTS</u>S<u>TGS</u>P | 594 | 384 | 2 plates (168) |
| LCW554 | (CBD-like) | MA<u>ST</u>PE<u>SGS</u>SG | 595 | 32 | 1 plate (84) |

Figure 9:
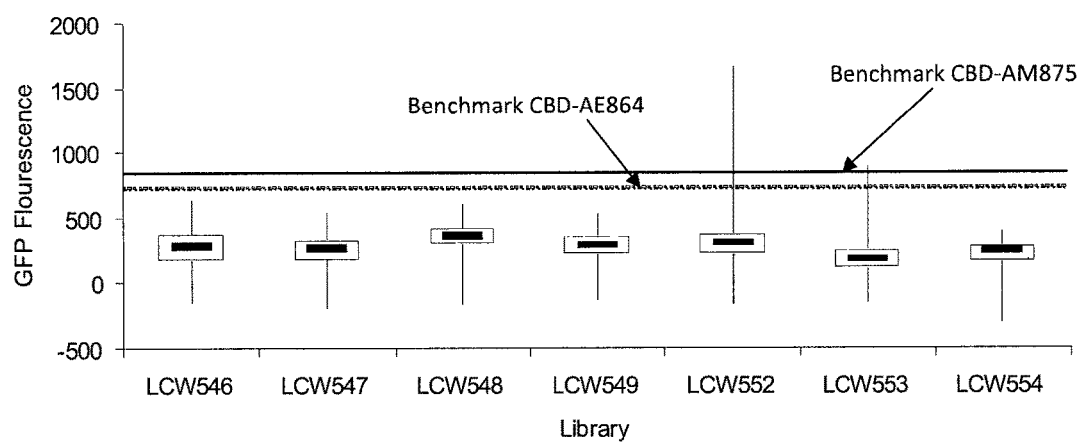
FIG. 9 shows results of expression assays for the indicated constructs comprising GFP and XTEN sequences. The expression cultures were assayed using a fluorescence plate reader (excitation 395 nm, emission 510 nm) to determine the amount of GFP reporter present. The results, graphed as box and whisker plots, indicate that while median expression levels were approximately half of the expression levels compared to the "benchmark" CBD N-terminal helper domain, the best clones from the libraries were much closer to the benchmarks, indicating that further optimization around those sequences was warranted. The results also show that the libraries starting with amino acids MA had better expression levels than those beginning with ME (see Example 14).

The saturated overnight cultures were used to inoculate fresh 500 μl cultures in auto-induction media in which they were grown overnight at 26° C. These expression cultures were then assayed using a fluorescence plate reader (excitation 395 nm, emission 510 nm) to determine the amount of GFP reporter present (see FIG. 9 for results of expression assays). The results, graphed as box and whisker plots, indicate that while median expression levels were approximately half of the expression levels compared to the "benchmark" CBD N-terminal helper domain, the best clones from the libraries were much closer to the benchmarks, indicating that further optimization around those sequences was warranted. This is in contrast to previous XTEN versions that were <25% of the expression levels of the CBD N-terminal benchmark. The results also show that the libraries starting with amino acids MA had better expression levels than those beginning with ME. This was most apparent when looking at the best clones, which were closer to the benchmarks as they mostly start with MA. Of the 176 clones within 33% of the CBD-AM875 benchmark, 87% begin with MA, whereas only 75% of the sequences in the libraries beginning with MA, a clear over representation of the clones beginning with MA at the highest level of expression. 96 of the best clones were sequenced to confirm identity and twelve sequences (see Table 14), 4 from LCW546, 4 from LCW547 and 4 from LCW552 were selected for further optimization.

TABLE 14

Advanced 12mer DNA Nucleotide Sequences

| Clone | DNA Nucleotide Sequence | SEQ ID NO: |
|---|---|---|
| LCW546_02 | ATGGCTAGTCCGGCTGGCTCTCCGACCTCCACTGAGGAAGGTACTTCTACT | 596 |
| LCW546_06 | ATGGCTAGTCCTGCTGGCTCTCCAACCTCCACTGAGGAAGGTACTTCTACT | 597 |
| LCW546_07 | ATGGCTAGTCCAGCAGGCTCTCCTACCTCCACCGAGGAAGGTACTTCTACT | 598 |
| LCW546_09 | ATGGCTAGTCCTGCTGGCTCTCCGACCTCTACTGAGGAAGGTACTTCTACT | 599 |
| LCW547_03 | ATGGCTACATCCGAAAGCGCAACCCCTGAGTCCGGTCCAGGTACTTCTACT | 600 |
| LCW547_06 | ATGGCTACATCCGAAAGCGCAACCCCTGAATCTGGTCCAGGTACTTCTACT | 601 |
| LCW547_10 | ATGGCTACGTCTGAAAGCGCTACTCCGGAATCTGGTCCAGGTACTTCTACT | 602 |
| LCW547_17 | ATGGCTACGTCCGAAAGCGCTACCCCTGAATCCGGTCCAGGTACTTCTACT | 603 |
| LCW552_03 | ATGGCTAGTTCTACCCCGTCTGGTGCAACCGGTTCCCCAGGTACTTCTACT | 604 |
| LCW552_05 | ATGGCTAGCTCCACTCCGTCTGGTGCTACCGGTTCCCCAGGTACTTCTACT | 605 |
| LCW552_10 | ATGGCTAGCTCTACTCCGTCTGGTGCTACTGGTTCCCCAGGTACTTCTACT | 606 |
| LCW552_11 | ATGGCTAGTTCTACCCCTTCTGGTGCTACTGGTTCTCCAGGTACTTCTACT | 607 |

Example 15: Construction of N-Terminal Extensions of XTEN-Construction and Screening of Libraries Optimizing Codons 3 and 4

Figure 11:
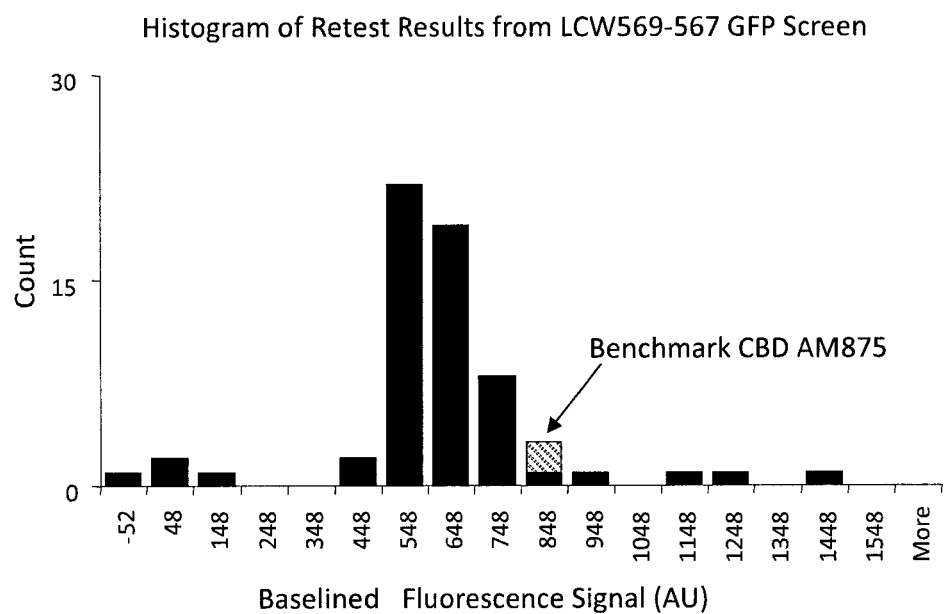
FIG. 11 shows a histogram of a retest of the top 75 clones after the optimization step, as described in Example 15, for GFP fluorescence signal, relative to the benchmark CBD_AM875 construct. The results indicated that several clones were now superior to the benchmark clones.

This example details a step in the optimization of the N-terminus of the XTEN protein to promote the initiation of translation to allow for expression of XTEN fusions at the N-terminus of proteins without the presence of a helper domain. With preferences for the first two codons established (see Example supra), the third and fourth codons were randomized to determine preferences. Three libraries, based upon best clones from LCW546, LCW547 and LCW552, were designed with the third and fourth residues modified such that all combinations of allowable XTEN codons were present at these positions (see FIG. 10). In order to include all the allowable XTEN codons for each library, nine pairs of oligonucleotides encoding 12 amino acids with codon diversities of third and fourth residues were designed, annealed and ligated into the NdeI/BsaI restriction enzyme digested stuffer vector pCW0551 (Stuffer-XTEN_AM875-GFP), and transformed into E. coli BL21Gold(DE3) competent cells to obtain colonies of three libraries LCW0569-571. With 24 XTEN codons the theoretical diversity of each library is 576 unique clones. A total of 504 individual colonies from the three created libraries were picked and grown overnight to saturation in 500 µl of super broth media in a 96 deep well plate. This provided sufficient coverage to understand relative library performance and sequence preferences. The saturated overnight cultures were used to inoculate new 500 µl cultures in auto-induction media in which were grown overnight at 26° C. These expression cultures were then assayed using a fluorescence plate reader (excitation 395 nm, emission 510 nm) to determine the amount of GFP reporter present. The top 75 clones from the screen were sequenced and retested for GFP reporter expression versus the benchmark samples (see FIG. 11). 52 clones yielded usable sequencing data and were used for subsequent analysis. The results were broken down by library and indicate that LCW546 was the superior library. The results are presented in Table 15. Surprisingly, it was discovered that base-lined fluorescence readings for the best clones were ~900 AU, whereas the CBD N-terminal benchmark was only ~600 AU. This indicates that this library had instituted an approximately 33% improvement over the best clones from the previous library which were approximately equal in expression to the CBD N-terminal benchmark (Example 14).

TABLE 15

Third and Fourth Codon Optimization Library Comparison

|  | LCW569 | LCW570 | LCW571 |
| --- | --- | --- | --- |
| N | 21 | 15 | 16 |
| Mean Fluorescence (AU) | 628 | 491 | 537 |
| SD | 173 | 71 | 232 |
| CV | 28% | 15% | 43% |

Further trends were seen in the data showing preferences for particular codons at the third and fourth position. Within the LCW569 library the glutamate codon GAA at the third position and the threonine codon ACT were associated with higher expression as seen in Table 16.

TABLE 16

Preferred Third and Fourth Codons in LCW569

|  | 3 = GAA | Rest | 4 = ACT | Rest |
| --- | --- | --- | --- | --- |
| N | 8 | 13 | 4 | 17 |
| Mean Fluorescence (AU) | 749 | 554 | 744 | 601 |
| SD | 234 | 47 | 197 | 162 |
| CV | 31% | 9% | 26% | 27% |

Additionally, the retest of the top 75 clones indicated that several were now superior to the benchmark clones.

Figure 12:
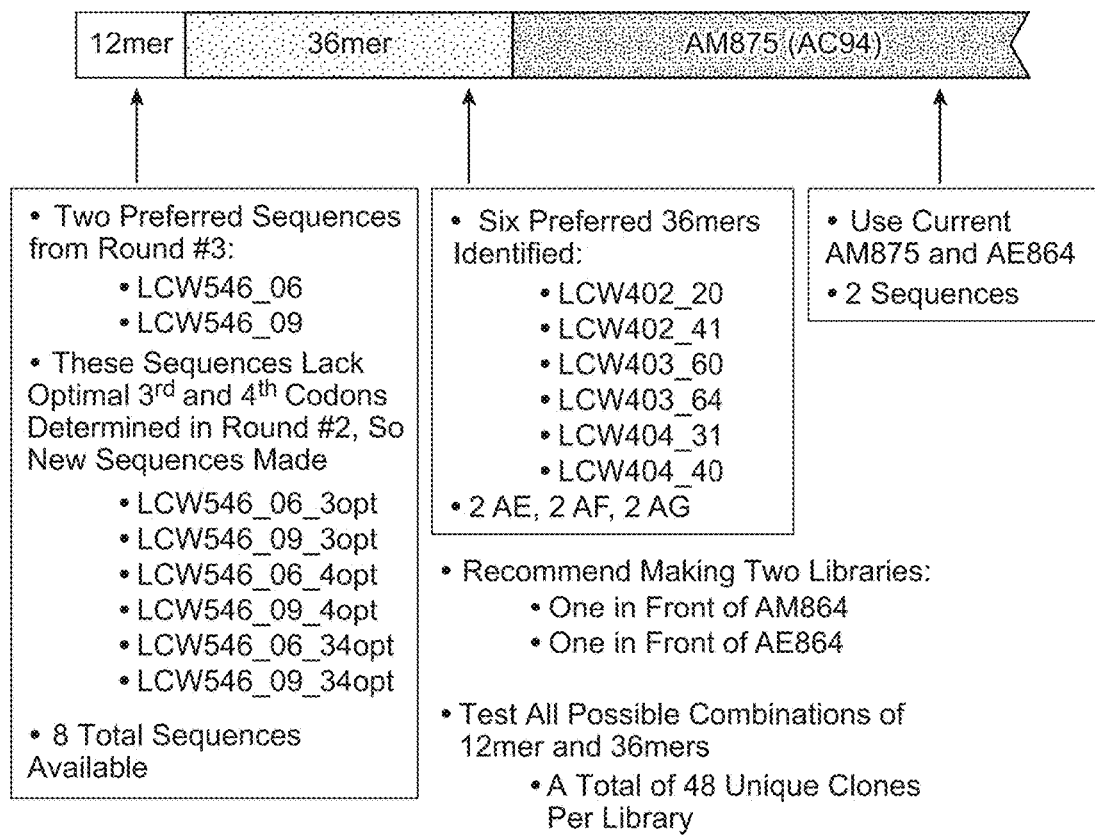
FIG. 12 is a schematic of a combinatorial approach undertaken for the union of codon optimization preferences for two regions of the N-terminus 48 amino acids. The approach created novel 48mers at the N-terminus of the XTEN protein for evaluation of the optimization of expression that resulted in leader sequences that may be a solution for expression of XTEN proteins where the XTEN is N-terminal to the GH.

Example 16: Construction of N-Terminal Extensions of XTEN-Construction and Screening of Combinatorial 12mer and 36mer Libraries This example details a step in the optimization of the N-terminus of the XTEN protein to promote the initiation of translation to allow for expression of XTEN fusions at the N-terminus of proteins without the presence of a helper domain. With preferences for the first two codons established (see Example supra), the N-terminus was examined in a broader context by combining the 12 selected 12mer sequences (see Example supra) at the very N-terminus followed by 125 previously constructed 36mer segments (see example supra) in a combinatorial manner. This created novel 48mers at the N-terminus of the XTEN protein and enabled the assessment of the impact of longer-range interactions at the N-terminus on expression of the longer sequences (FIG. 12). Similar to the dimerization procedures used to assemble 36mers (see Example infra), the plasmids containing the 125 selected 36mer segments were digested with restriction enzymes BbsI/NcoI and the appropriate fragment was gel-purified. The plasmid from clone AC94 (CBD-XTEN_AM875-GFP) was also digested with BsaI/NcoI and the appropriate fragments were gel-purified. These fragments were ligated together and transformed into E. coli BL21Gold(DE3) competent cells to obtain colonies of the library LCW0579, which also served as the vector for further cloning 12 selected 12mers at the very N-terminus. The plasmids of LCW0579 were digested with NdeI/EcoRI/BsaI and the appropriate fragments were gel-purified. 12 pairs of oligonucleotides encoding 12 selected 12mer sequences were designed, annealed and ligated with the NdeI/EcoRI/BsaI digested LCW0579 vector, and transformed into E. coli BL21Gold(DE3) competent cells to obtain colonies of the library LCW0580. With a theoretical diversity of 1500 unique clones, a total of 1512 individual colonies from the created library were picked and grown overnight to saturation in 500 µl of super broth media in a 96 deep well plate. This provided sufficient coverage to understand relative library performance and sequence preferences. The saturated overnight cultures were used to inoculate new 500 µl cultures in auto-induction media that were grown overnight at 26° C. These expression cultures were then assayed using a fluorescence plate reader (excitation 395 nm, emission 510 nm) to determine the amount of GFP reporter present. The top 90 clones were sequenced and retested for GFP reporter expression. 83 clones yielded usable sequencing data and were used for subsequent analysis. The sequencing data was used to determine the lead 12mer that was present in each clone and the impact of each 12mer on expression was assessed. Clones LCW546_06 and LCW546_09 stood out as being the superior N-terminus (see Table 17).

TABLE 17

Relative Performance of Clones Starting with LCW546_06 and LCW459_09

|  | LCW546_06 | All Others | LCW546_09 | All Others |
|---|---|---|---|---|
| N | 11 | 72 | 9 | 74 |
| Mean Fluorescence (AU) | 1100 | 752 | 988 | 775 |
| SD | 275 | 154 | 179 | 202 |
| CV | 25% | 20% | 18% | 26% |

The sequencing and retest also revealed several instances of independent replicates of the same sequence in the data producing similar results, thus increasing confidence in the assay. Additionally, 10 clones with 6 unique sequences were superior to the benchmark clone. They are presented in Table 18. It was noted that these were the only occurrences of these sequences and in no case did one of these sequences occur and fail to beat the bench-mark clone. These six sequences were advanced for further optimization.

TABLE 18

Combinatorial 12mer and 36mer Clones Superior to Benchmark Clone

| Clone Name | First 60 codons | SEQ ID NO: | 12mer Name | 36mer Name |
|---|---|---|---|---|
| LCW580_51 | ATGGCTAGTCCTGCTGGCTCTCCAACCTCCACT GAGGAAGGTGCATCCCCGGGCACCAGCTCTACC GGTTCTCCAGGTAGCTCTACCCCGTCTGGTGCT ACCGGCTCTCCAGGTAGCTCTACCCCGTCTGGT GCTACTGGCTCTCCAGGTACTTCTACTGAACCG TCTGAAGGCAGCGCA | 608 | LCW546_06 | LCW0404_040 |
| LCW580_81 | ATGGCTAGTCCTGCTGGCTCTCCAACCTCCACT GAGGAAGGTGCATCCCCGGGCACCAGCTCTACC GGTTCTCCAGGTAGCTCTACCCCGTCTGGTGCT ACCGGCTCTCCAGGTAGCTCTACCCCGTCTGGT GCTACTGGCTCTCCAGGTACTTCTACTGAACCG TCTGAAGGCAGCGCA | 609 | LCW546_06 | LCW0404_040 |
| LCW580_38 | ATGGCTAGTCCTGCTGGCTCTCCAACCTCCACT GAGGAAGGTACTTCTACCGAACCGTCCGAGGGT AGCGCACCAGGTAGCCCAGCAGGTTCTCCTACC TCCACCGAGGAAGGTACTTCTACCGAACCGTCC GAGGGTAGCGCACCAGGTACTTCTACTGAACCG TCTGAAGGCAGCGCA | 610 | LCW546_06 | LCW0402_041 |
| LCW580_63 | ATGGCTAGTCCTGCTGGCTCTCCGACCTCTACT GAGGAAGGTACTTCTACTGAACCGTCTGAAGGC AGCGCACCAGGTAGCGAACCGGCTACTTCCGGT TCTGAAACCCCAGGTAGCCCAGCAGGTTCTCCA ACTTCTACTGAAGAAGGTACTTCTACTGAACCG TCTGAAGGCAGCGCA | 611 | LCW546_09 | LCW0402_020 |
| LCW580_06 | ATGGCTAGTCCTGCTGGCTCTCCAACCTCCACT GAGGAAGGTACCCCGGGTAGCGGTACTGCTTCT TCCTCTCCAGGTAGCTCTACCCCTTCTGGTGCAA CCGGCTCTCCAGGTGCTTCTCCGGGCACCAGCT CTACCGGTTCTCCAGGTACTTCTACTGAACCGT CTGAAGGCAGCGCA | 612 | LCW546_06 | LCW0404_031 |
| LCW580_35 | ATGGCTAGTCCTGCTGGCTCTCCGACCTCTACT GAGGAAGGTACTTCTACTGAACCGTCTGAAGGC AGCGCACCAGGTAGCGAACCGGCTACTTCCGGT TCTGAAACCCCAGGTAGCCCAGCAGGTTCTCCA ACTTCTACTGAAGAAGGTACTTCTACTGAACCG TCTGAAGGCAGCGCA | 613 | LCW546_09 | LCW0402_020 |
| LCW580_67 | ATGGCTAGTCCTGCTGGCTCTCCGACCTCTACT GAGGAAGGTACCTCCCCTAGCGGCGAATCTTCT ACTGCTCCAGGTACCTCTCCTAGCGGCGAATCT TCTACCGCTCCAGGTACCTCCCCTAGCGGTGAA TCTTCTACCGCACCAGGTACTTCTACTGAACCG TCTGAAGGCAGCGCA | 614 | LCW546_09 | LCW0403_064 |
| LCW580_13 | ATGGCTAGTCCTGCTGGCTCTCCGACCTCTACT GAGGAAGGTACCTCTACTCCGGAAAGCGGTTCC GCATCTCCAGGTTCTACCAGCGAATCCCCGTCT GGCACCGCACCAGGTTCTACTAGCTCTACTGCT GAATCTCCGGGCCCAGGTACTTCTACTGAACCG TCTGAAGGCAGCGCA | 615 | LCW546_09 | LCW0403_060 |
| LCW580_88 | ATGGCTAGTCCTGCTGGCTCTCCGACCTCTACT GAGGAAGGTACCTCCCCTAGCGGCGAATCTTCT | 616 | LCW546_09 | LCW0403_064 |

TABLE 18-continued

Combinatorial 12mer and 36mer Clones Superior to Benchmark Clone

| Clone Name | First 60 codons | SEQ ID NO: | 12mer Name | 36mer Name |
|---|---|---|---|---|
| | ACTGCTCCAGGTACCTCTCCTAGCGGCGAATCT<br>TCTACCGCTCCAGGTACCTCCCCTAGCGGTGAA<br>TCTTCTACCGCACCAGGTACTTCTACTGAACCG<br>TCTGAAGGCAGCGCA | | | |
| LCW580_11 | ATGGCTAGTCCTGCTGGCTCTCCGACCTCTACT<br>GAGGAAGGTACCTCTACTCCGGAAAGCGGTTCC<br>GCATCTCCAGGTTCTACCAGCGAATCCCCGTCT<br>GGCACCGCACCAGGTTCTACTAGCTCTACTGCT<br>GAATCTCCGGGCCCAGGTACTTCTACTGAACCG<br>TCTGAAGGCAGCGCA | 617 | LCW546_09 | LCW0403_060 |

Example 17: Construction of N-Terminal Extensions of XTEN-Construction and Screening of Combinatorial 12mer and 36mer Libraries for XTEN-AM875 and XTEN-AE864

This example details a step in the optimization of the N-terminus of the XTEN protein to promote the initiation of translation to allow for expression of XTEN fusions at the N-terminus of proteins without the presence of a helper domain. With preferences for the first four codons (see Examples supra, and for the best pairing of N-terminal 12mers and 36mers (see Example supra) established, a combinatorial approach was undertaken to examine the union of these preferences. This created novel 48mers at the N-terminus of the XTEN protein and enabled the testing of the confluence of previous conclusions. Additionally, the ability of these leader sequences to be a universal solution for all XTEN proteins was assessed by placing the new 48mers in front of both XTEN-AE864 and XTEN-AM875. Instead of using all 125 clones of 36mer segment, the plasmids from 6 selected clones of 36mer segment with best GFP expression in the combinatorial library were digested with NdeI/EcoRI/BsaI and the appropriate fragments were gel-purified. The plasmids from clones AC94 (CBD-XTEN_AM875-GFP) and AC104 (CBD-XTEN_AE864-GFP) were digested with digested with NdeI/EcoRI/BsaI and the appropriate fragments were gel-purified. These fragments were ligated together and transformed into E. coli BL21Gold(DE3) competent cells to obtain colonies of the libraries LCW0585 (-XTEN_AM875-GFP) and LCW0586 (-XTEN_AE864-GFP), which could also serve as the vectors for further cloning 8 selected 12mers at the very N-terminus. The plasmids of LCW0585 and LCW0586 were digested with NdeI/EcoRI/BsaI and the appropriate fragments were gel-purified. 8 pairs of oligonucleotides encoding 8 selected 12mer sequences with best GFP expression in the previous (Generation 2) screening were designed, annealed and ligated with the NdeI/EcoRI/BsaI digested LCW0585 and LCW0586 vectors, and transformed into E. coli BL21Gold(DE3) competent cells to obtain colonies of the final libraries LCW0587 (XTEN_AM923-GFP) and LCW0588 (XTEN_AE912-GFP). With a theoretical diversity of 48 unique clones, a total of 252 individual colonies from the created libraries were picked and grown overnight to saturation in 500 µl of super broth media in a 96 deep well plate. This provided sufficient coverage to understand relative library performance and sequence preferences. The saturated overnight cultures were used to inoculate new 500 µl cultures in auto-induction media in which were grown overnight at 26° C. These expression cultures were then assayed using a fluorescence plate reader (excitation 395 nm, emission 510 nm) to determine the amount of GFP reporter present. The top 36 clones were sequenced and retested for GFP reporter expression. 36 clones yielded usable sequencing data and these 36 were used for the subsequent analysis. The sequencing data determined the 12mer, the third codon, the fourth codon and the 36mer present in the clone and revealed that many of the clones were independent replicates of the same sequence. Additionally, the retest results for these clones are close in value, indicating the screening process was robust. Preferences for certain combinations at the N-terminus were seen and were consistently yielding higher fluorescence values approximately 50% greater than the benchmark controls (see Tables 19 and 20). These date support the conclusion that the inclusion of the sequences encoding the optimized N-terminal XTEN into the fusion protein genes conferred a marked enhancement on the expression of the fusion proteins.

TABLE 19

Preferred N-terminal Combinations for XTEN-AM875

| Clone Name | Number of Replicates | 12mer | 36mer | Mean | SD | CV |
|---|---|---|---|---|---|---|
| CBD-AM875 | NA | NA | NA | 1715 | 418 | 16% |
| LCW587_08 | 7 | LCW546_06_3 = GAA | LCW404_40 | 2333 | 572 | 18% |
| LCW587_17 | 5 | LCW546_09_3 = GAA | LCW403_64 | 2172 | 293 | 10% |

TABLE 20

Preferred N-terminal Combinations for XTEN-AE864

| Clone Name | Number of Replicates | 12mer | 36mer | Mean | SD | CV |
|---|---|---|---|---|---|---|
| AC82 | NA | NA | NA | 1979 | 679 | 24% |
| LCW588_14 | 8 | LCW546_06_opt3 | LCW404_31 | 2801 | 240 | 6% |
| LCW588_27 | 2 | LCW546_06_opt34 | LCW404_40 | 2839 | 556 | 15% |

Figure 13:
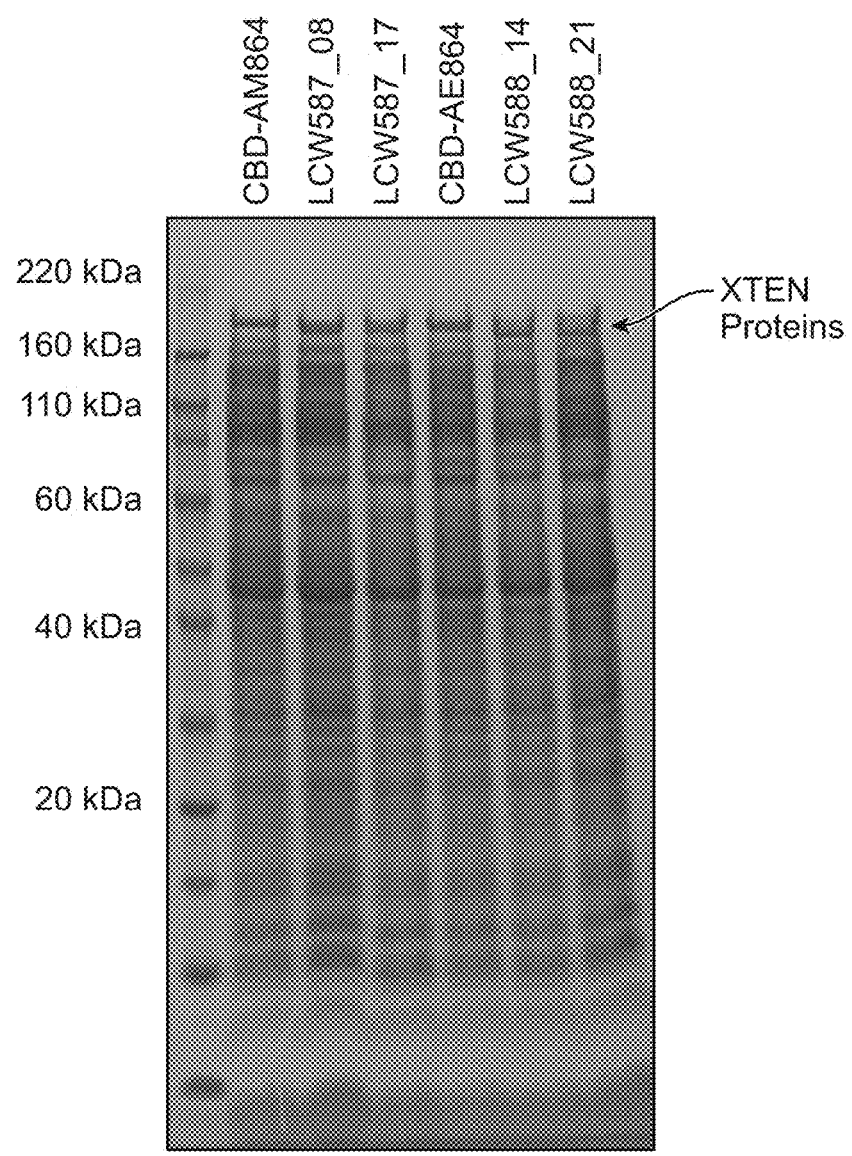
FIG. 13 shows an SDS-PAGE gel confirming expression of preferred clones obtained from the XTEN N-terminal codon optimization experiments, in comparison to benchmark XTEN clones comprising CBD leader sequences at the N-terminus of the construct sequences, as described in Example 17.

Notably, the preferred combination of the N-terminal for the XTEN-AM875 and the preferred combination for the XTEN-AE864 are not the same (Tables 19 and 20), indicating more complex interactions further than 150 bases from the initiation site influence expression levels. The sequences for the preferred nucleotide sequences are listed in Table 21 and the preferred clones were analyzed by SDS-PAGE to independently confirm expression (see FIG. 13). The complete sequences of XTEN_AM923 and XTEN_AE912 were selected for further analysis.

annealed into sequence motifs 502 such as a 12 amino acid motif ("12-mer"), which is subsequently ligated with an oligo containing BbsI, and KpnI restriction sites 503. The motif libraries can be limited to specific sequence XTEN families; e.g., AD, AE, AF, AG, AM, or AQ sequences of Table 1. In this case, the motifs of the AE family would be used as the motif library, which are annealed to the 12-mer to create a "building block" length; e.g., a segment that encodes 36 amino acids. The gene encoding the XTEN sequence can be assembled by ligation and multimerization

TABLE 21

Preferred DNA Nucleotide Sequences for first 48 Amino Acid Residues of N-terminal XTEN-AM875 and XTEN-AE864

| Clone Name | XTEN Modified | DNA Nucleotide Sequence | SEQ ID NO: |
|---|---|---|---|
| LCW587_08 | AM875 | ATGGCTGAACCTGCTGGCTCTCCAACCTCCACTGAGGAAGGTGCATC CCCGGGCACCAGCTCTACCGGTTCTCCAGGTAGCTCTACCCCGTCTG GTGCTACCGGCTCTCCAGGTAGCTCTACCCCGTCTGGTGCTACTGGC TCTCCAGGTACTTCTACTGAACCGTCTGAAGGCAGCGCA | 618 |
| LCW587_17 | AM875 | ATGGCTGAACCTGCTGGCTCTCCGACCTCTACTGAGGAAGGTACCTC CCCTAGCGGCGAATCTTCTACTGCTCCAGGTACCTCTCCTAGCGGCG AATCTTCTACCGCTCCAGGTACCTCCCCTAGCGGTGAATCTTCTACC GCACCAGGTACTTCTACTGAACCGTCTGAAGGCAGCGCA | 619 |
| LCW588_14 | AE864 | ATGGCTGAACCTGCTGGCTCTCCAACCTCCACTGAGGAAGGTACCCC GGGTAGCGGTACTGCTTCTTCCTCTCCAGGTAGCTCTACCCCTTCTGG TGCAACCGGCTCTCCAGGTGCTTCTCCGGGCACCAGCTCTACCGGTT CTCCAGGTAGCCCGGCTGGCTCTCCTACCTCTACTGAG | 620 |
| LCW588_27 | AE864 | ATGGCTGAAACTGCTGGCTCTCCAACCTCCACTGAGGAAGGTGCATC CCCGGGCACCAGCTCTACCGGTTCTCCAGGTAGCTCTACCCCGTCTG GTGCTACCGGCTCTCCAGGTAGCTCTACCCCGTCTGGTGCTACTGGC TCTCCAGGTAGCCCGGCTGGCTCTCCTACCTCTACTGAG | 621 |

Example 18: Methods of Producing and Evaluating GHXTEN; XTEN-hGH as Example

A general schema for producing and evaluating GHXTEN compositions is presented in FIG. 6, and forms the basis for the general description of this Example. Using the disclosed methods and those known to one of ordinary skill in the art, together with guidance provided in the illustrative examples, a skilled artesian can create and evaluate a range of GHXTEN fusion proteins comprising, XTENs, GH and variants of GH known in the art. The Example is, therefore, to be construed as merely illustrative, and not limitative of the methods in any way whatsoever; numerous variations will be apparent to the ordinarily skilled artisan. In this Example, a GHXTEN of human growth hormone linked to an XTEN of the AE family of motifs would be created.

The general scheme for producing polynucleotides encoding XTEN is presented in FIGS. 4 and 5. FIG. 5 is a schematic flowchart of representative steps in the assembly of a XTEN polynucleotide construct in one of the embodiments of the invention. Individual oligonucleotides 501 are annealed into sequence motifs 502 such as a 12 amino acid motif ("12-mer"), which is subsequently ligated with an oligo containing BbsI, and KpnI restriction sites 503. The motif libraries can be limited to specific sequence XTEN families; e.g., AD, AE, AF, AG, AM, or AQ sequences of Table 1. In this case, the motifs of the AE family would be used as the motif library, which are annealed to the 12-mer to create a "building block" length; e.g., a segment that encodes 36 amino acids. The gene encoding the XTEN sequence can be assembled by ligation and multimerization of the "building blocks" until the desired length of the XTEN gene 504 is achieved. As illustrated in FIG. 5, the XTEN length in this case is 48 amino acid residues, but longer lengths can be achieved by this process. For example, multimerization can be performed by ligation, overlap extension, PCR assembly or similar cloning techniques known in the art. The XTEN gene can be cloned into a stuffer vector. In the example illustrated in FIG. 5, the vector can encode a Flag sequence 506 followed by a stuffer sequence that is flanked by BsaI, BbsI, and KpnI sites 507 and a GH gene (e.g., hGH) 508, resulting in the gene encoding the GHXTEN 500, which, in this case encodes the fusion protein in the configuration, N- to C-terminus, XTEN-hGH.

DNA sequences encoding GH can be conveniently obtained by standard procedures known in the art from a cDNA library prepared from an appropriate cellular source, from a genomic library, or may be created synthetically (e.g., automated nucleic acid synthesis) using DNA sequences obtained from publicly available databases, patents, or literature references. A gene or polynucleotide encoding the GH portion of the protein can be then be cloned into a construct, such as those described herein, which can be a plasmid or other vector under control of appropriate transcription and translation sequences for high level protein expression in a biological system. A second gene or polynucleotide coding for the XTEN portion (in the case of FIG. 5 illustrated as an AE with 48 amino acid residues) can be genetically fused to the nucleotides encoding the N-terminus of the hGH gene by cloning it into the construct adjacent and in frame with the gene coding for the hGH, through a ligation or multimerization step. In this manner, a chimeric DNA molecule coding for (or complementary to) the XTEN-hGH GHXTEN fusion protein would be generated within the construct. Optionally, a gene encoding for a second XTEN could be inserted and ligated in-frame to the nucleotides encoding the C-terminus of the XTEN-hGH gene, resulting in a construct encoding an XTEN-hGH-XTEN fusion protein. The construct can be designed in different configurations to encode the various permutations of the fusion partners as a monomeric polypeptide. For example, the gene can be created to encode the fusion protein in the order (N- to C-terminus): hGH-XTEN; XTEN-hGH; hGH-XTEN-hGH; XTEN-hGH-XTEN; as well as multimers of the foregoing. Optionally, this chimeric DNA molecule may be transferred or cloned into another construct that is a more appropriate expression vector. At this point, a host cell capable of expressing the chimeric DNA molecule would be transformed with the chimeric DNA molecule. The vectors containing the DNA segments of interest can be transferred into an appropriate host cell by well-known methods, depending on the type of cellular host, as described supra.

Host cells containing the XTEN-GH expression vector would be cultured in conventional nutrient media modified as appropriate for activating the promoter. The culture conditions, such as temperature, pH and the like, are those previously used with the host cell selected for expression, and will be apparent to the ordinarily skilled artisan. After expression of the fusion protein, cells would be harvested by centrifugation, disrupted by physical or chemical means, and the resulting crude extract retained for purification of the fusion protein, as described below. For GHXTEN compositions secreted by the host cells, supernatant from centrifugation would be separated and retained for further purification.

Gene expression would be measured in a sample directly, for example, by conventional Southern blotting, Northern blotting to quantitate the transcription of mRNA [Thomas, Proc. Natl. Acad. Sci. USA, 77:5201-5205 (1980)], dot blotting (DNA analysis), or in situ hybridization, using an appropriately labeled probe, based on the sequences provided herein. Alternatively, gene expression would be measured by immunological of fluorescent methods, such as immunohistochemical staining of cells to quantitate directly the expression of gene product. Antibodies useful for immunohistochemical staining and/or assay of sample fluids may be either monoclonal or polyclonal, and may be prepared in any mammal Conveniently, the antibodies may be prepared against the hGH sequence polypeptide using a synthetic peptide based on the sequences provided herein or against exogenous sequence fused to hGH and encoding a specific antibody epitope. Examples of selectable markers are well known to one of skill in the art and include reporters such as enhanced green fluorescent protein (EGFP), beta-galactosidase (β-gal) or chloramphenicol acetyltransferase (CAT).

The XTEN-hGH polypeptide product would be purified via methods known in the art. Procedures such as gel filtration, affinity purification, salt fractionation, ion exchange chromatography, size exclusion chromatography, hydroxyapatite adsorption chromatography, hydrophobic interaction chromatography or gel electrophoresis are all techniques that may be used in the purification. Specific methods of purification are described in Robert K. Scopes, Protein Purification: Principles and Practice, Charles R. Castor, ed., Springer-Verlag 1994, and Sambrook, et al., supra. Multi-step purification separations are also described in Baron, et al., Crit. Rev. Biotechnol. 10:179-90 (1990) and Below, et al., J. Chromatogr. A. 679:67-83 (1994).

As illustrated in FIG. 6, the isolated XTEN-hGH fusion proteins would then be characterized for their chemical and activity properties. Isolated fusion protein would be characterized, e.g., for sequence, purity, apparent molecular weight, solubility and stability using standard methods known in the art. The fusion protein meeting expected standards would then be evaluated for activity, which can be measured in vitro or in vivo by measuring one of the growth hormone-associated parameters described herein, using one or more assays disclosed herein, or using the assays of the Examples or Table 34.

In addition, the XTEN-hGH fusion protein would be administered to one or more animal species to determine standard pharmacokinetic parameters, as described in Examples 30-32.

By the iterative process of producing, expressing, and recovering XTEN-hGH constructs, followed by their characterization using methods disclosed herein or others known in the art, the GHXTEN compositions comprising hGH and an XTEN can be produced and evaluated by one of ordinary skill in the art to confirm the expected properties such as enhanced solubility, enhanced stability, improved pharmacokinetics and reduced immunogenicity, leading to an overall enhanced therapeutic activity compared to the corresponding unfused hGH. For those fusion proteins not possessing the desired properties, a different sequence can be constructed, expressed, isolated and evaluated by these methods in order to obtain a composition with such properties.

Example 19: Construction of Genes and Vectors of hGH Linked to K and Y XTEN Sequences K Series GHXTEN Constructs A pET-series vector was constructed with T7 promoter, which expresses a protein containing cellulose binding domain (CBD) at the N-terminus, followed by a Tomato Etch Virus (TEV) protease cleavage site, followed by the hGH coding sequence, and by the K288 coding sequence: CBD-K288-hGH. The K288 has the repetitive sequence (GEGGGEGGE)$_{32}$ (SEQ ID NO: 622). The CBD sequence used is shown in Swissprot file Q06851 and the purification of CBD fusion proteins is described in Ofir, K. et al. (2005) Proteomics 5:1806. The sequence of the TEV cleavage site is ENLYFQ/X (SEQ ID NO: 623); G was used in the X position. This construct was transformed into BL21(DE3)-star E. coli strain and grown under conditions promoting expression. Cells were collected and disrupted. The cellular supernatant was applied on beaded cellulose resin (Perloza 100), washed with buffer A (25 mM Tris pH=8.0) and eluted from the column with 20 mM NaOH. pH was adjusted by titrating the sample with 1M Tris buffer pH=8.0. Protein purity was estimated to be above 90%. The eluted protein was digested with purified TEV protease overnight at 4° C., and the digested sample was applied to a beaded cellulose resin (Perloza 100). The CBD was retained on the column, and the K288-hGH was found in the column flow-through.

Figure 20:
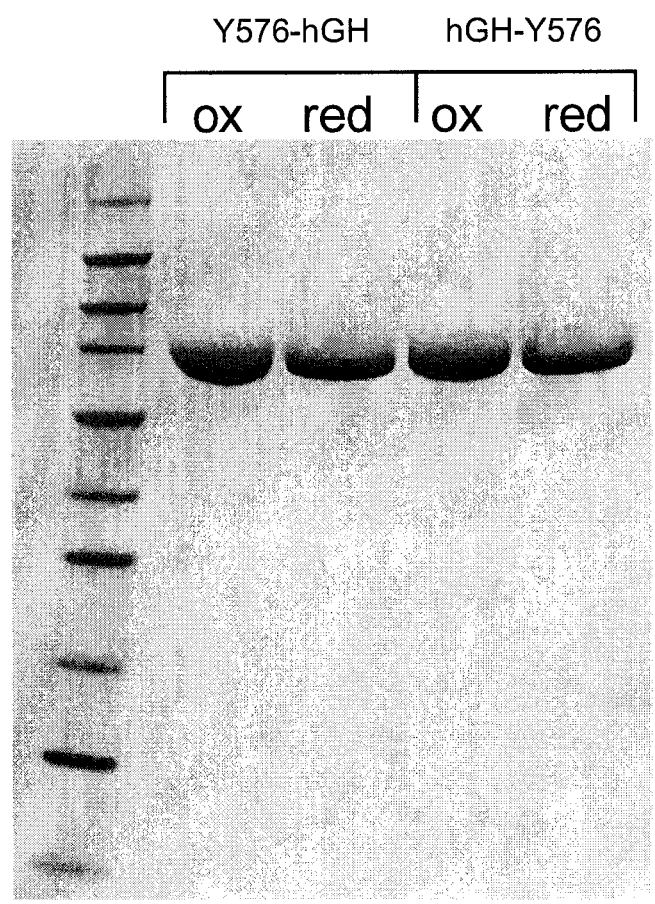
FIG. 20 shows SDS-PAGE analysis of 5 μg of final purified protein of hGH fused to Y576 in the configurations of hGH-Y576 and Y576-hGH subjected to both non-reducing and reducing SDS-PAGE, as described in Example 24, using NuPAGE 4-12% Bis-Tris gel from Invitrogen according to manufacturer's specifications.

The pooled flow-through was loaded on the anion-exchange (Q-sepharose, Pharmacia), washed with buffer A (25 mM Tris pH=8.0) and eluted from the column using a shallow linear gradient of same buffer with 1M NaCl. The eluted fusion protein was pooled, dialyzed against buffer A, concentrated, and purified by size-exclusion chromatography (SEC) as the final purification. Protein purity was estimated to be above 98%. The final protein is K288-hGH. SDS PAGE analyses of samples throughout the purification process are shown in FIG. 20.

Y Series GHXTEN Constructs

The gene encoding hGH was amplified by polymerase chain reaction (PCR), which introduced BbsI and HindIII restriction sites that are compatible with the BbsI and HindIII sites that flank the stuffer in the XTEN destination vector. The pCBD-XTEN plasmid is a pET30 derivative from Novagen in the format of Cellulose Binding Domain (CBD)-XTEN-Stuffer, where Stuffer is green fluorescent protein (GFP) and XTEN can be any length from 36 to 576 or greater. Constructs were generated by replacing a stuffer sequence in pCBD-XTEN with the hGH-encoding fragment (FIG. 7B). The pCBD-XTEN features a T7 promoter upstream of CBD followed by an XTEN sequence fused in-frame upstream of the stuffer sequence. The XTEN sequences employed belong to family XTEN_Y and encode lengths that include 36, 72, 144, 288, and 576 amino acids. The stuffer fragment was removed by restriction digest using BbsI and HindIII endonucleases. Restriction digested hGH DNA fragment was ligated into the cleaved pCBD-XTEN vector using T4 DNA ligase and electroporated into BL21 (DE3) Gold (Stratagene). Transformants were screened by DNA miniprep and the desired construct was confirmed by DNA sequencing. The final vector yields the CBD_XTEN-_hGH gene under the control of a T7 promoter. The resulting DNA sequences encoded for GH linked to XTEN of lengths of 36, 72, 144, and 288 amino acids, respectively.

Example 20: Construction of hGH-XTEN Genes and Vectors Using AE and AM XTEN Sequences The gene encoding hGH was amplified by polymerase chain reaction (PCR), which introduced NdeI and BbsI restriction sites that are compatible with the NdeI and BsaI sites that flank the stuffer in the XTEN destination vector. The pXTEN plasmid is a pET30 derivative from Novagen in the format of Stuffer-XTEN, where Stuffer can be either green fluorescent protein (GFP) or CBD and XTEN can be any length from 36 to 1318 amino acids or greater (FIG. 7). Constructs were generated by replacing a stuffer sequence in pXTEN with the hGH-encoding fragment. The pXTEN features a T7 promoter upstream of the stuffer sequence, and an XTEN sequence fused in-frame downstream of the stuffer sequence. The XTEN sequences employed belong to the AE or AM family of XTEN and encode lengths that include 36, 72, 144, 288, 576, 864, 875 and 1318 amino acids. The stuffer fragment was removed by restriction digest using NdeI and BsaI endonucleases. Restriction digested hGH DNA fragment was ligated into the cleaved pXTEN vector using T4 DNA ligase and electroporated into BL21(DE3) Gold (Stratagene). Transformants were screened by DNA miniprep and the desired constructs were confirmed by DNA sequencing. The final vector yields the hGH-XTEN gene under the control of a T7 promoter, and would be used to express a fusion protein with hGH at the N-terminus.

Example 21: Construction of XTEN-hGH and XTEN-hGH Genes and Vectors Using AE and AM XTEN Sequences The gene encoding hGH was amplified by polymerase chain reaction (PCR), which introduced BbsI and HindIII restriction sites that are compatible with the BbsI and HindIII sites that flank the stuffer in the XTEN destination vector. The pCBD-XTEN plasmid is a pET30 derivative from Novagen in the format of Cellulose Binding Domain (CBD)-XTEN-Stuffer, where Stuffer is green fluorescent protein (GFP) and XTEN can be any length from 36 to 1318 or greater (FIG. 7). Constructs were generated by replacing a stuffer sequence in pCBD-XTEN with the hGH-encoding fragment. The pCBD-XTEN features a T7 promoter upstream of CBD followed by an XTEN sequence fused in-frame upstream of the stuffer sequence. The XTEN sequences employed belong to family XTEN_AE and XTEN_AM and encode lengths that include 36, 72, 144, 288, 576, 864, 875 and 1318 amino acids. The stuffer fragment was removed by restriction digest using BbsI and HindIII endonucleases. Restriction digested hGH DNA fragment was ligated into the cleaved pCBD-XTEN vector using T4 DNA ligase and electroporated into BL21(DE3) Gold (Stratagene). Transformants were screened by DNA miniprep and the desired construct was confirmed by DNA sequencing. The final vector yields the CBD_XTEN_hGH gene under the control of a T7 promoter, and would be used to express a fusion protein with hGH at the C-terminus.

Example 22: Construction of XTEN-AE_hGH_XTEN-AE Genes and Vectors

Figure 8:
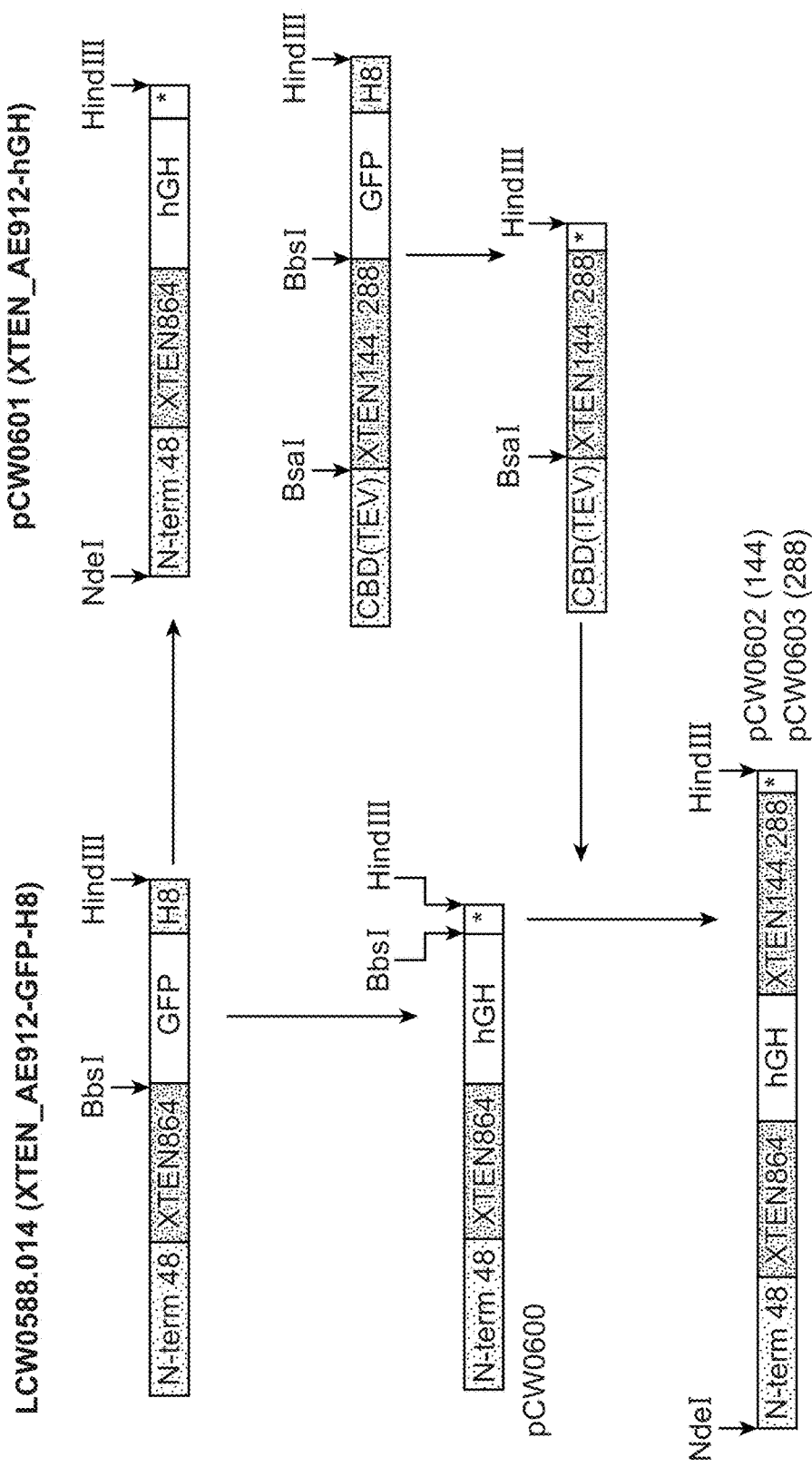
FIG. 8 is a schematic representation of the step-wise construction of GHXTEN genes that contain N-terminal XTEN encoding sequences linked to hGH and the subsequent linkage of sequences encoding either 144 or 288 XTEN linked to the C-terminus of XTEN, as described in Example 22.

The gene encoding hGH was amplified by polymerase chain reaction (PCR), which introduced BsaI and HindIII restriction sites that are compatible with the BbsI and HindIII sites that flank the stuffer in the pNTS-XTEN destination vector. The pNTS-XTEN_AE plasmid is a pET30 derivative from Novagen in the format of N-terminal XTEN expression sequence of 48 amino acids-XTEN-Stuffer, where Stuffer is green fluorescent protein (GFP) and XTEN can be any length from 36 to 576 or greater. Constructs were generated by replacing a stuffer sequence in pNTS-XTEN with the hGH-encoding fragment. The pNTS-XTEN features a T7 promoter upstream of NTS followed by an XTEN sequence fused in-frame upstream of the stuffer sequence. The XTEN sequences employed belong to family XTEN_AE and encode lengths that can include 36, 72, 144, 288, 576, 864, and 1296 amino acids. The stuffer fragment was removed by restriction digest using BbsI and HindIII endonucleases. Restriction digested hGH DNA fragment was ligated into the cleaved pNTS-XTEN vector using T4 DNA ligase and electroporated into BL21(DE3) Gold (Stratagene). In some cases, a second XTEN_AE sequence of 144 or 288 amino acids was ligated to the C-terminus of the hGH encoding gene, the steps of which are illustrated in FIG. 8. The gene encoding hGH was amplified by polymerase chain reaction (PCR), which introduced BsaI and HindIII (with additional BbsI in front of HindIII) restriction sites that are compatible with the BbsI and HindIII sites that flank the stuffer in the pNTS-XTEN destination vector. After restriction enzyme digestions, ligation and transformation, the resulting intermediate plasmid has the format of pNTS-XTEN-hGH with the BbsI/HindIII restriction sites at the C-terminus of hGH. The intermediate plasmid was further digested with BbsI and HindIII, ligated with the second XTEN_AE sequence of 144 or 288 amino acids flanked by BsaI and HindIII, placing the AE144 or the AE288 encoding sequences at the C-terminus of the XTEN-hGH gene, and transformed into BL21(DE3)Gold. Transformants were screened by DNA miniprep and the desired construct was confirmed by DNA sequencing. The final vectors, described above, yield the genes in configurations of either NTS_XTEN_hGH or NTS_XTEN_hGH_XTEN, under the control of a T7 promoter, as shown in FIGS. 7C and 7D.

Example 23: Purification of GHXTEN_AE Constructs

Protein Expression

The plasmids described above were transformed into BL21(DE3)-Gold *E. coli* strain (Novagen) and plated on an LB-agar plate with the appropriate antibiotics and grown overnight at 37° C. A single colony was inoculated into 5 ml of TB125 medium and grown overnight at 37° C. The next day the inoculum was transformed into a 2 L vessel with 500 ml of TB125, and grown until an OD=0.6 was reached, followed by continued growth at 26° C. for 16 hr with 0.1 mM IPTG.

Cells were collected by centrifugation and the cell pellet was resuspended in 50 ml Buffer containing 5 mM Tris pH 8.0, 100 mM NaCl. Cells were disrupted using an APV-2000 homogenizer. The pH of the lysate was then adjusted to pH 4.5 with acetic acid to precipitate contaminating host cell proteins and was subsequently clarified by centrifugation. The clarified, acid-treated lysate was then applied to a DE52 Anion exchange chromatography column and eluted with NaCl. The eluted fraction was then further acidified to pH 4.2 and applied to a MacroCapSP cation exchange chromatography column Product was eluted using sequential elution with NaCl. An additional chromatography step employing Macrocap Q was implemented to remove product-related aggregates and residual host cell impurities (e.g. endotoxin, DNA, host cell protein).

Protein purity was estimated to be above 98%. The quantity of eluted fusion protein was determined by SDS-PAGE analysis and by measurement of total protein concentration. The high quantity of eluted GHXTEN fusion protein reflects the higher degree of solubility of the fusion protein relative to hGH not linked to XTEN (see, e.g., Singh, S. M., et al. (2005) *J Biosci Bioeng*, 99: 303; Patra, A. K., et al. (2000) *Protein Expr Purif*, 18: 182), as well as the ability to remain soluble at acidified conditions that result in the precipitation of host cell protein.

Final Formulation and Storage

The buffer exchanged proteins were then concentrated using 10K MWCO Vivacell 100 centrifugal ultrafiltration unit to not less than 15 mg/ml. The concentrate was sterile filtered using a 0.22 um syringe filter. The final solution was aliquoted and stored at −80° C.

Example 24: Characterization of GHXTEN Constructs

SDS-PAGE Analysis

5 µg of final purified GHXTEN proteins of GH linked to Y576 (either N- or C-terminus of Y576) was subjected to both non-reducing and reducing SDS-PAGE using NuPAGE 4-12% Bis-Tris gel from Invitrogen according to manufacturer's specifications. The resulting gel is shown in FIG. 20.

Analytical Size Exclusion Chromatography

Size exclusion chromatography analysis was performed using a TSKGel-G4000 SWXL (7.8 mm×30 cm) column. 20 ug of the purified protein at a concentration of 1 mg/ml was separated at a flowrate of 0.6 ml/min in 20 mM phosphate pH 6.8, 114 mM NaCl. Chromatogram profiles were monitored using OD214 nm and OD280 nm. Column calibration was performed using a size exclusion calibration standard from BioRad, the markers include thyroglobulin (670 kDa), bovine gamma-globulin (158 kDa), chicken ovalbumin (44 kDa), equine myoglobuin (17 kDa) and vitamin B12 (1.35 kDa). The chromatographic profiles of Y576-GH were generated and demonstrate that the apparent molecular weight of each construct is significantly larger than that expected for a globular protein, in comparison to the standard proteins run in the same assay (data not shown).

Analytical RP-HPLC

Analytical RP-HPLC chromatography analysis was performed using a C4 (7.8 mm×20 cm) column. The column was equilibrated with 100% AcetonNitrile plus 0.1% TFA in the mobile phase at a flowrate of 1 ml/min. Twenty micro gram of the purified protein, with and without denaturing, at a concentration of 0.2 mg/ml was injected separately. The protein was separated and eluted by liner gradient within 15 min from 5% to 60% of buffer containing HPLC grade H20 plus 0.1% TFA. Chromatogram profiles were monitored using OD214 nm and OD280 nm. The chromatographic profiles of native and denatured Y576-GH are shown as an overlay in FIG. 21.

Example 25: ELISA-Based Binding Assays

Figure 15:
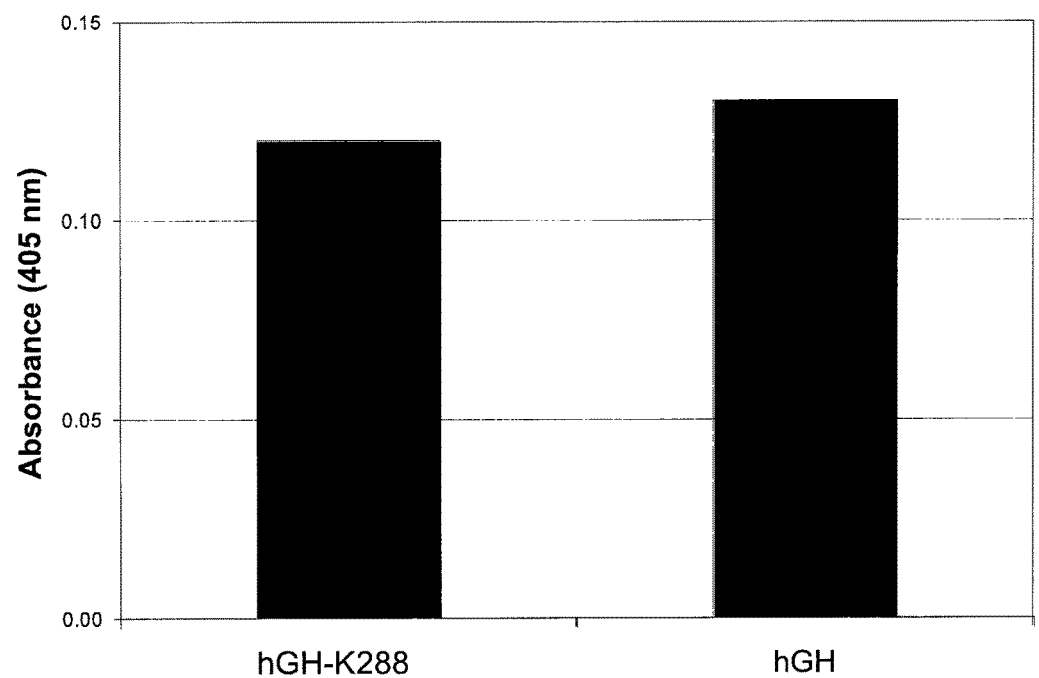
FIG. 15 shows the results of a receptor binding assay for hGH in which the binding activity of hGH fused to K288 polypeptide is compared to free hGH, as described in Example 25.
Figure 16:
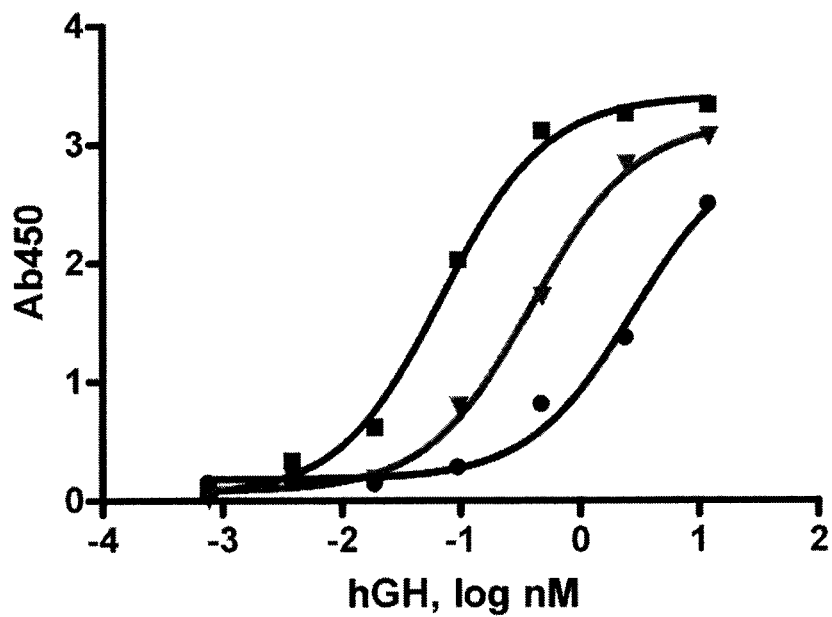
FIG. 16 shows the results of in vitro binding affinity assay of hGH-AM864 (circles) and AM864-hGH (inverted triangles) to hGHR-Fc, as described in Example 25. Unmodified recombinant hGH (squares) is shown for comparison.
Figure 18:
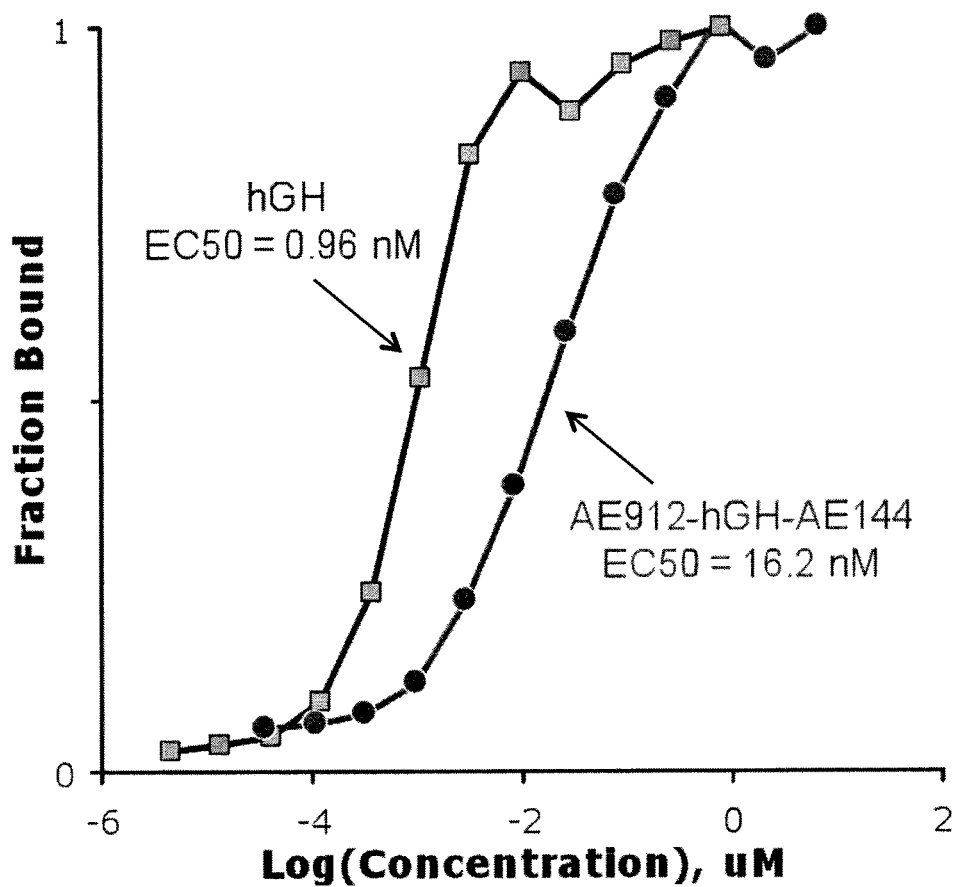
FIG. 18 shows results of an ELISA-based assay to determine the ability of addition of a C-terminus XTEN to reduce binding affinity of GHXTEN to bind to GH receptor, as described in Example 25.
Figure 19:
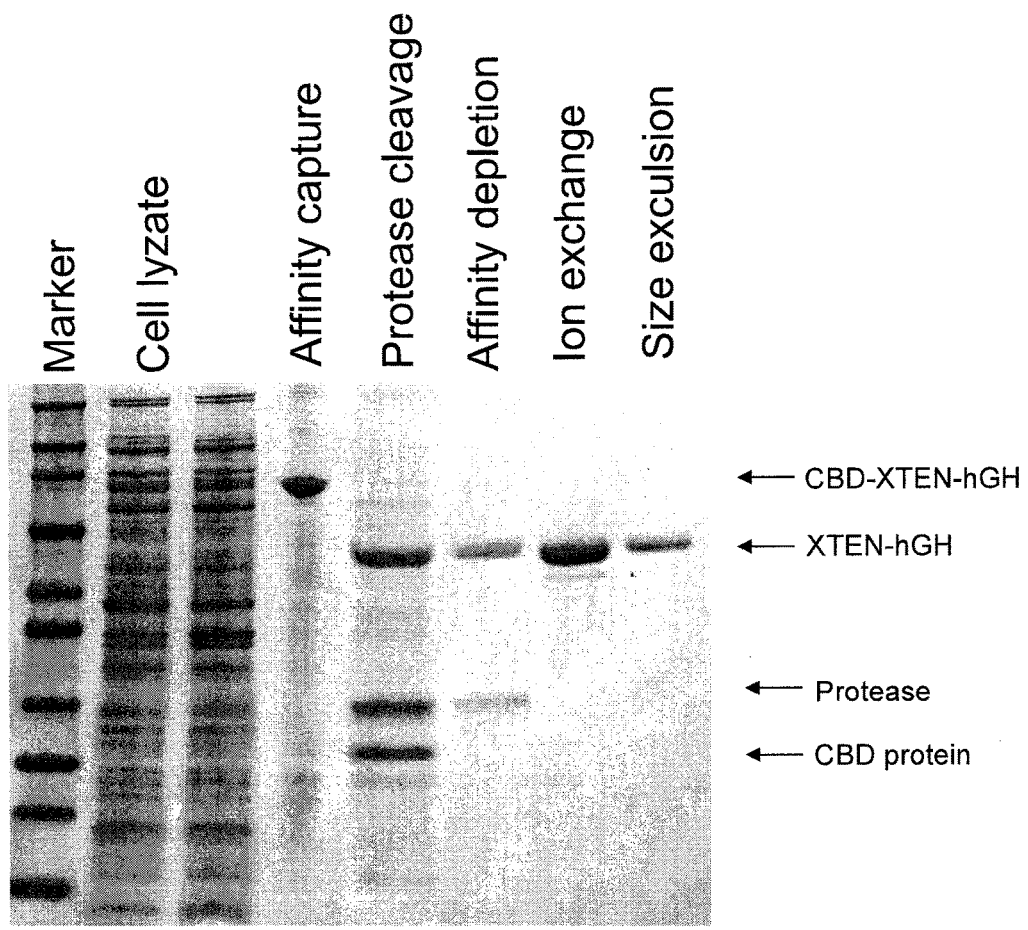
FIG. 19 shows SDS-PAGE analysis of hGH fused to K288, with samples from throughout the purification process, as described in Example 19.

XTEN fusions to GH were tested in a standard ELISA-based assay to evaluate their ability to bind to GH Receptor. Assays were performed using a sandwich ELISA format in which a recombinant hGH receptor (hGHR-Fc) is coated onto wells of an ELISA plate. The wells were then blocked, washed, and GHXTEN samples are then incubated in the wells at varying dilutions to allow capture of the GHXTEN. Wells were washed extensively, and bound protein was detected using a biotinylated preparation of a polyclonal or monoclonal anti-GH or anti-XTEN antibody and streptavidin HRP. The fraction of bound protein can be calculated by comparing the colorimetric response at each serum dilution to a standard curve of unmodified GH. In a first assay comparing hGH bound to K288 compared to recombinant hGH, the results, show in FIG. 15, demonstrate the ability of GHXTEN to bind to the hGH receptor. In a second assay, two configurations of GHXTEN; AM864-hGH and hGH-AM864; compared to recombinant hGH. The results, shown in FIG. 16, indicate apparent EC50 values for native hGH of 0.0701 nM, AM864-hGH of 0.3905, and hGH-AM864 of 2.733. In a third assay, recombinant hGH was compared to AE912-hGH-AE144 in order to show the ability to reduce binding affinity by the addition of a C-terminal XTEN to the hGH component of an GHXTEN fusion protein, and the results (FIG. 18) demonstrate a decrease in binding affinity of approximately 17-fold compared to hGH.

Example 26: Effect of Heat Treatment on the Stability of hGH and GHXTEN

The ability of XTEN to confer structural stability on the attached therapeutic molecule was investigated. Samples of hGH and AM864-hGH were incubated at 25° C. and 80° C., and then analyzed by gel electrophoresis and Coomassie staining FIG. 17A is an SDS-PAGE gel of the two preparations treated at 25° C. and 80° C. for 15 minutes, while FIG. 17B shows the corresponding percentage of receptor binding activity of the 80° C. sample relative to the 25° C. treatment. The results indicate that hGH denatures under the treatment conditions while the GHXTEN construct remains largely stable under the experimental conditions, retaining nearly 80% of its receptor binding activity.

Conclusions:

The XTEN component of the GHXTEN fusion protein confers enhanced solubility and stability properties to the fusion protein in comparison to hGH not linked to XTEN.

Example 27: Comparative Effects of hGH and AM864-hGH on Secretion of IGF-1

Figure 24:
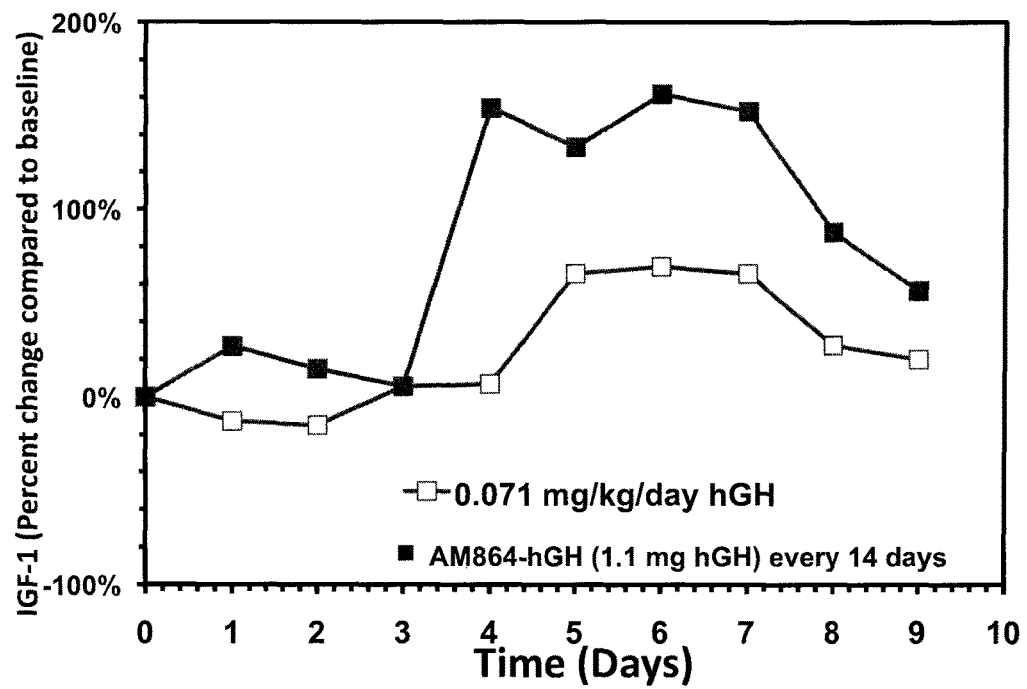
FIG. 24 shows the results of IGF-1 secretion in cynomolgus monkeys in response to administration of hGH or the GHXTEN AM864-hGH at the doses indicated, as described in Example 27.

The ability of a GHXTEN to retain pharmacologic potency was assessed using the measured parameter of circulating IGF-1 in response to administered compound. FIG. 24 shows the effects of daily administration of hGH (0.071 mg/kg daily) or a single dose of AM864-hGH (5 mg/kg; equivalent to 1.1 mg/kg) on circulating IGF-1 levels in cynomolgus monkeys (n=4/group), depicted as percentage change compared to baseline. The results show enhanced activity by the GHXTEN construct, despite being dosed only once at the beginning of the experiment.

Example 28: Comparative Effects of hGH and AM864-hGH on Body Weight Gain

Figure 25:
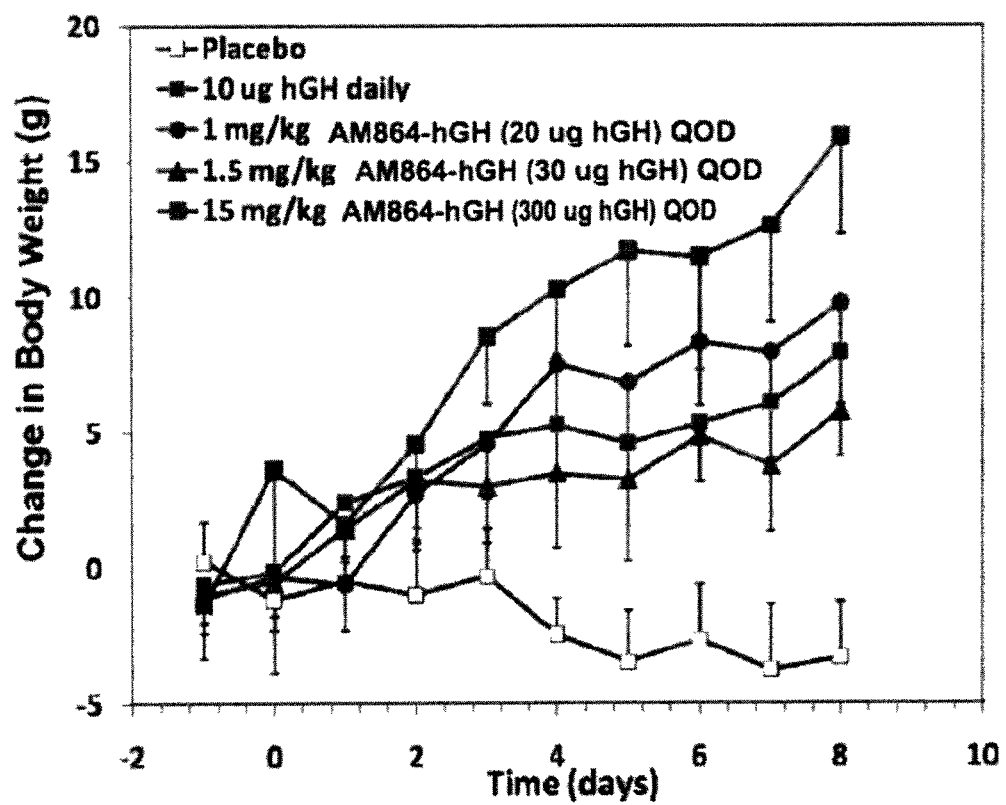
FIG. 25 shows the effects of administration of hGH or AM864-hGH at the indicated doses on body weight in a hypox rat model, as described in Example 28. The results show retention of biologic activity by the GHXTEN constructs that is equivalent in potency to hGH, yet with less frequent dosing.

The ability of a GHXTEN to retain pharmacologic potency was assessed using the measured parameter of body weight gain in a hypox rat in response to administered compound. FIG. 25 shows the effects of administration of hGH or AM864-hGH at the indicated doses and dose frequency on body weight in hypox rats. The results show retention of biologic activity by the GHXTEN constructs that is equivalent in potency to comparable dosage of hGH, yet with less frequent dosing. Increased dosage of AM864-hGH led to increases in body weight gains showing enhancement of the pharmacodynamic properties of the GHXTEN compared to hGH under these conditions.

Example 29: Comparative Effects of hGH and AM864-hGH on Bone Cartilage

The ability of a GHXTEN to retain pharmacologic potency was assessed using the measured parameter of increase in tibial epiphyseal plate width in hypox rats. FIG. 26 shows the comparative effects of administration of placebo, hGH, and AM864-hGH, shown in histologic cross-sections of the tibia from rats after 9 days of treatment, with the margins denoted with dotted lines. Groups are the same as shown in FIG. 26. FIG. 26A shows that the placebo group had an average cross-section width of 344±38.6 µm of the plate after 9 days. FIG. 26B shows that the hGH group (10 µg daily) had an average cross-section width of 598±8.5 µm after 9 days. FIG. 26C shows that the AM864-hGH (15 mg/kg q3d) had an average cross-section width of 944±8.5 µm after 9 days. The results show enhanced activity by the GHXTEN construct compared to hGH, despite being dosed at less frequent intervals.

Example 30: PK Analysis of GHXTEN Protein Fusions

GH-Y576 and Y576 h-GH (in this case indicating the N- to C-terminus order of GH and XTEN) were injected into cynomolgus monkeys in order to determine in vivo pharmacokinetic parameters. The compositions were provided in an aqueous buffer and were administered by intravenous routes into separate animals at 0.15 mg/kg dosing. Serum samples were collected at various time points following administration and analyzed for serum concentrations of the accessory proteins. Analysis was performed using a sandwich ELISA format. Rabbit polyclonal anti-XTEN (to Y-type XTEN) antibodies were coated onto wells of an ELISA plate. Serum samples were then incubated in the wells at varying dilutions to allow capture of the compound by the coated antibodies. Wells were washed extensively, and bound protein was detected using a biotinylated preparation of the polyclonal anti-XTEN antibody and streptavidin HRP. Serum protein concentrations were calculated at each time point by comparing the colorimetric response at each serum dilution to a standard curve. Pharmacokinetic parameters were calculated using the WinNonLin software package.

Figure 22:
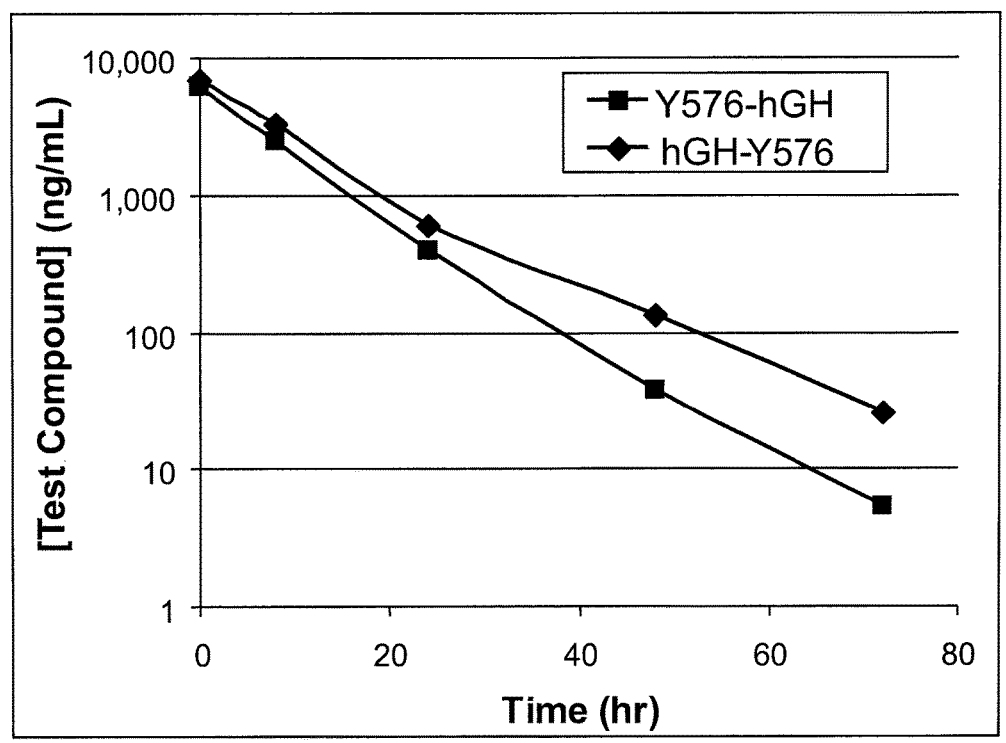
FIG. 22 shows the pharmacokinetic profile of two GHXTEN constructs Y576-GH and hGH-Y576 (N- to C-terminus) following intravenous administration to cynomolgus monkeys, as described in Example 30. The results show that the orientation (N- versus C-terminal) of hGH relative to the XTEN did not affect the clearance of the fusion proteins.

FIG. 22 shows the concentration profile of the two GH constructs following intravenous administration to cynomolgus monkeys. Following IV administration, the half-life was calculated to be 7 hours for hGH-Y576 and 10.5 hours for Y576-hGH. For reference, the published half-life of unmodified GH is well described in the literature as 10-15 minutes in adult humans (see, e.g., Hindmarch, P. C., et al., Clinical Endocrinology (2008) 30(4): 443-450). The results show that the orientation (N- versus C-terminal) of hGH relative to the XTEN did not affect the clearance of the fusion proteins, and that addition of the Y576 greatly extended the terminal half-life of the fusion protein.

Figure 23:
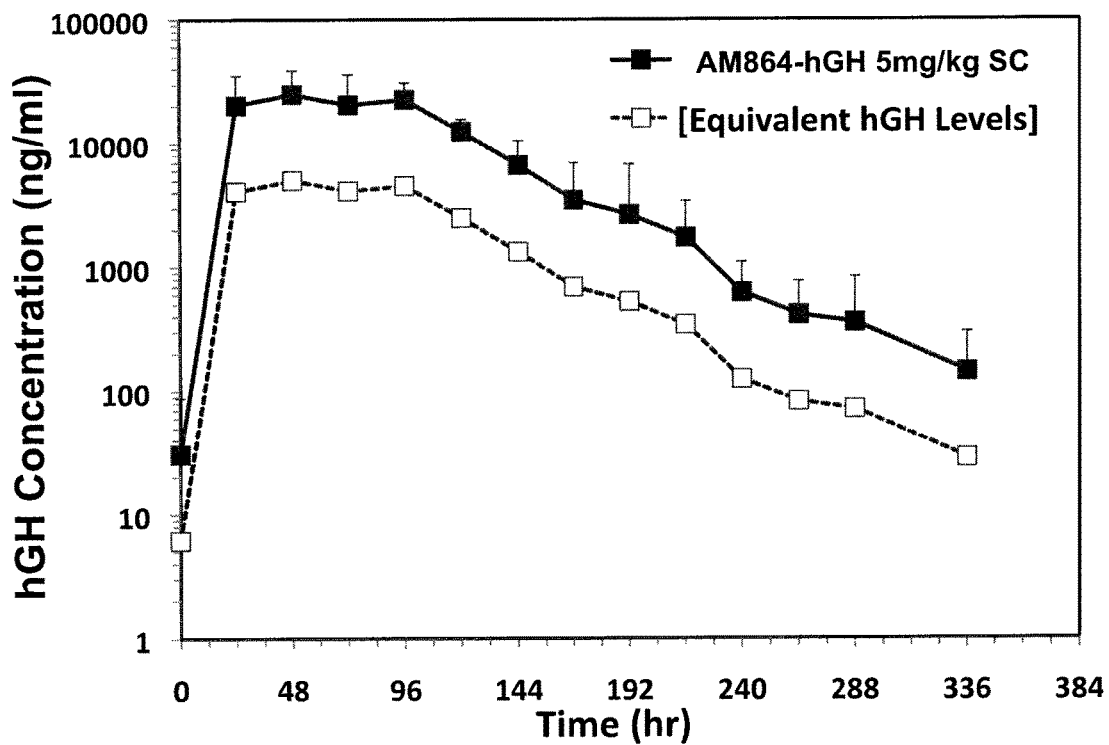
FIG. 23 shows the pharmacokinetic profile after a single dose of 5 mg/kg AM864-hGH administered subcutaneously to cynomolgus monkeys, with the derived equivalent hGH concentration shown (dashed line), as described in Example 30. Terminal half-life was calculated as 33 hours by WinNonLin using a single compartment fit.

Another pharmacokinetic study in cynomolgus monkeys was performed using the AM864-hGH construct. FIG. 23 shows the pharmacokinetic profile after a single dose of 5 mg/kg AM864-hGH administered subcutaneously to cynomolgus monkeys, with the derived equivalent hGH concentration shown (dashed line).

Conclusions:

The XTEN component of the GHXTEN fusion protein confers enhanced pharmacokinetic properties to the fusion protein in comparison to hGH not linked to XTEN, under these conditions.

Example 31: PK Analysis of hGH XTEN Fusion Polypeptides in Rats

The GHXTEN fusion proteins AE912-hGH, AM864-hGH (synonym to AM875-hGH for this and following Examples), AE912-hGH-AE144 and AE912-hGH-AE288 were evaluated in rats in order to determine in vivo pharmacokinetic parameters of the hGHXTEN polypeptides. All compositions were provided in an aqueous buffer and were administered by subcutaneous (SC) route into separate animals using 1.5 mg/kg single doses. Plasma samples were collected at various time points following administration and analyzed for concentrations of the test articles. Analysis was performed using a sandwich ELISA format. Recombinant hGHR-Fc was coated onto wells of an ELISA plate. The wells were blocked, washed and plasma samples were then incubated in the wells at varying dilutions to allow capture of the compound by the coated antibodies. Wells were washed extensively, and bound protein was detected using a biotinylated preparation of the polyclonal anti hGH antibody and streptavidin HRP. Concentrations of test article were calculated at each time point by comparing the colorimetric response at each serum dilution to a standard curve. Pharmacokinetic parameters were calculated using the WinNonLin software package.

Figure 27:
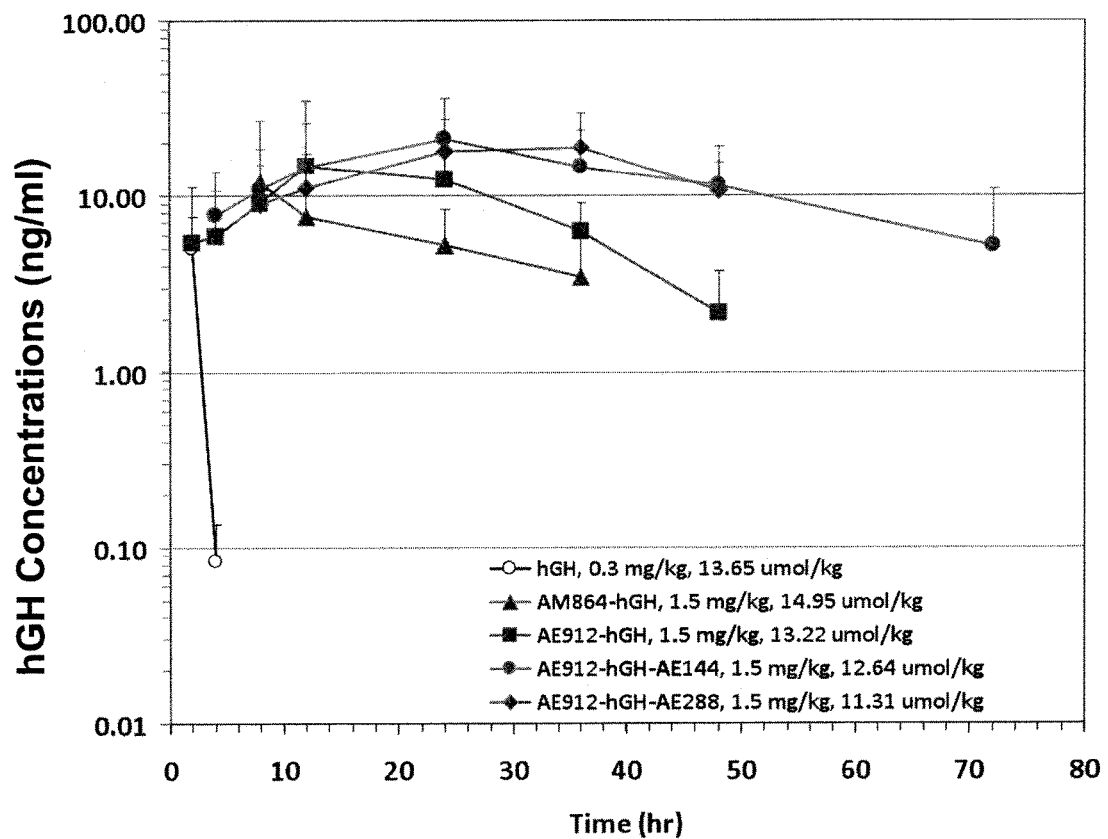
FIG. 27 shows the pharmacokinetic results of four hGH GHTXEN fusion proteins administered to rats by the subcutaneous route, compared to unmodified recombinant hGH, as described in Example 31.

FIG. 27 shows the concentration profiles of the four hGH XTEN constructs after subcutaneous administration. The calculated terminal half-life for AE912-hGH was 7.5 h, 6.8 h for AM864-hGH (synonym for AM875-hGH), 12.4 h for AE912-hGH-AE144 and 13.1 h for AE912-hGH-AE288. For comparison, unmodified hGH was run in parallel in the same experiment and showed a dramatically shorter plasma half-life.

Conclusions:

The incorporation of different XTEN sequences into fusion proteins comprising hGH results in significant enhancement of pharmacokinetic parameters for all four compositions compared to unmodified hGH, as demonstrated in the rodent model under these conditions. The addition of a second XTEN protein to the C-terminus of the AE-hGH constructs results in a further enhancement of the terminal half-life compared to the constructs with a single XTEN; likely due to reduced receptor mediated clearance.

Figure 28:
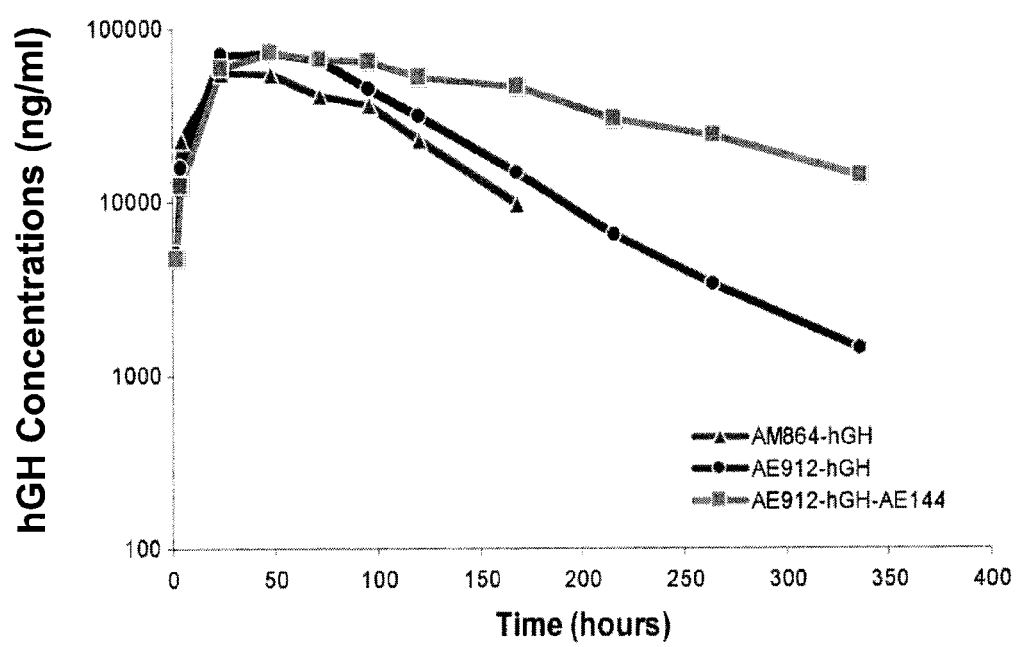
FIG. 28 shows the concentration profiles of three hGH XTEN constructs after subcutaneous administration to cynomolgus monkeys, as described in Example 32.

Example 32: PK Analysis of hGH XTEN Fusion Polypeptides in Cynomolgus Monkeys GHXTEN fusion proteins containing one or two XTEN molecules (AE912-hGH, AM864-hGH, and AE912-hGH-AE144) were evaluated in cynomolgus monkeys in order to determine the effect of the inclusion of a second XTEN on in vivo pharmacokinetic parameters of the hGHXTEN polypeptides. All compositions were provided in an aqueous buffer and were administered by subcutaneous (SC) route into separate animals using 1.5 mg/kg single doses. Plasma samples were collected at various time points following administration and analyzed for concentrations of the test articles. Analysis was performed using a sandwich ELISA format. Recombinant hGHR-Fc was coated onto wells of an ELISA plate. The wells were blocked, washed and plasma samples were then incubated in the wells at varying dilutions to allow capture of the compound by the coated antibodies. Wells were washed extensively, and bound protein was detected using a biotinylated preparation of the polyclonal anti hGH antibody and streptavidin HRP. Concentrations of test article were calculated at each time point by comparing the colorimetric response at each serum dilution to a standard curve. Pharmacokinetic parameters were calculated using the WinNonLin software package, and FIG. 28 shows the concentration profiles of the three hGH XTEN constructs after subcutaneous administration over the 336 h period. The average terminal half-life for the fusion proteins were 33 h for AM864-hGH, 44 h for AE912-hGH, and 110 h for the AE912-hGH-AE144 (containing two XTEN linked to the N- and C-termini of hGH).

Conclusions:

The incorporation of different XTEN sequences into fusion proteins comprising hGH resulted in significant enhancement of pharmacokinetic parameters for all three compositions, as demonstrated in the cyno model under these conditions, with the construct containing a second XTEN linked to the C-terminus of the hGH showing a greater than about two-fold enhancement of the terminal half-life compared to the GHXTEN with a single XTEN at the N-terminus.

Figure 29:
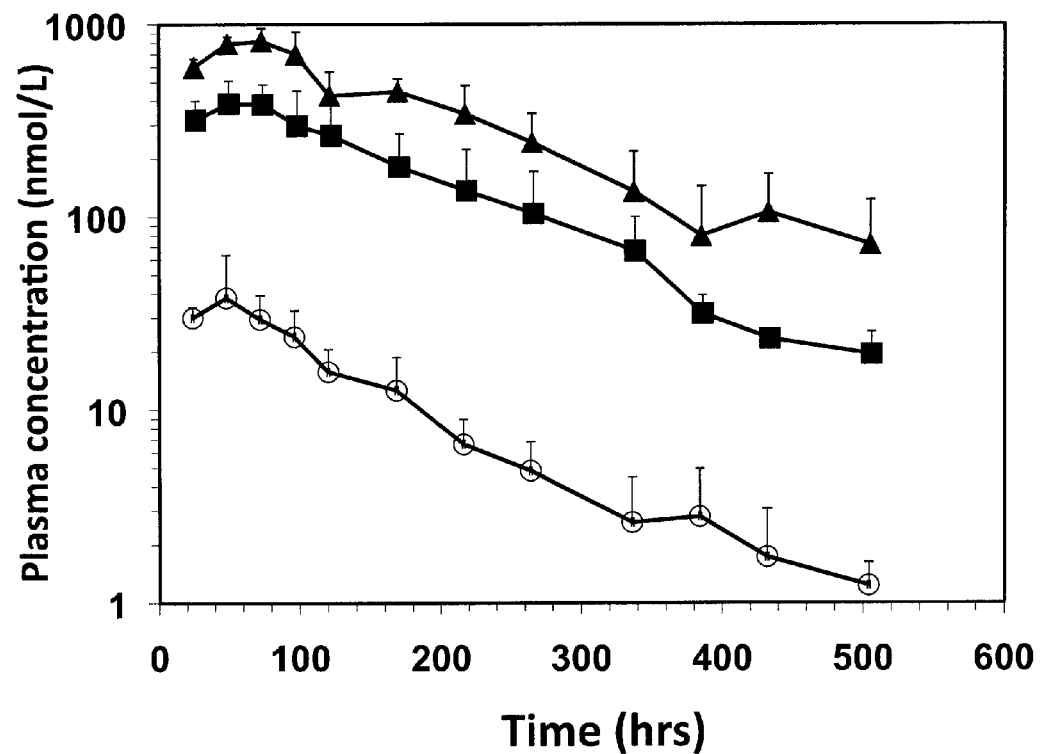
FIG. 29 shows the results of a pharmacokinetic study of three doses levels of the GHXTEN AE912-hGH-AE144 administered to male and female cynos SC at 0.3 (open circles), 1.5 (squares), and 7.5 mg/kg (triangles), as described in Example 33.
Figure 30:
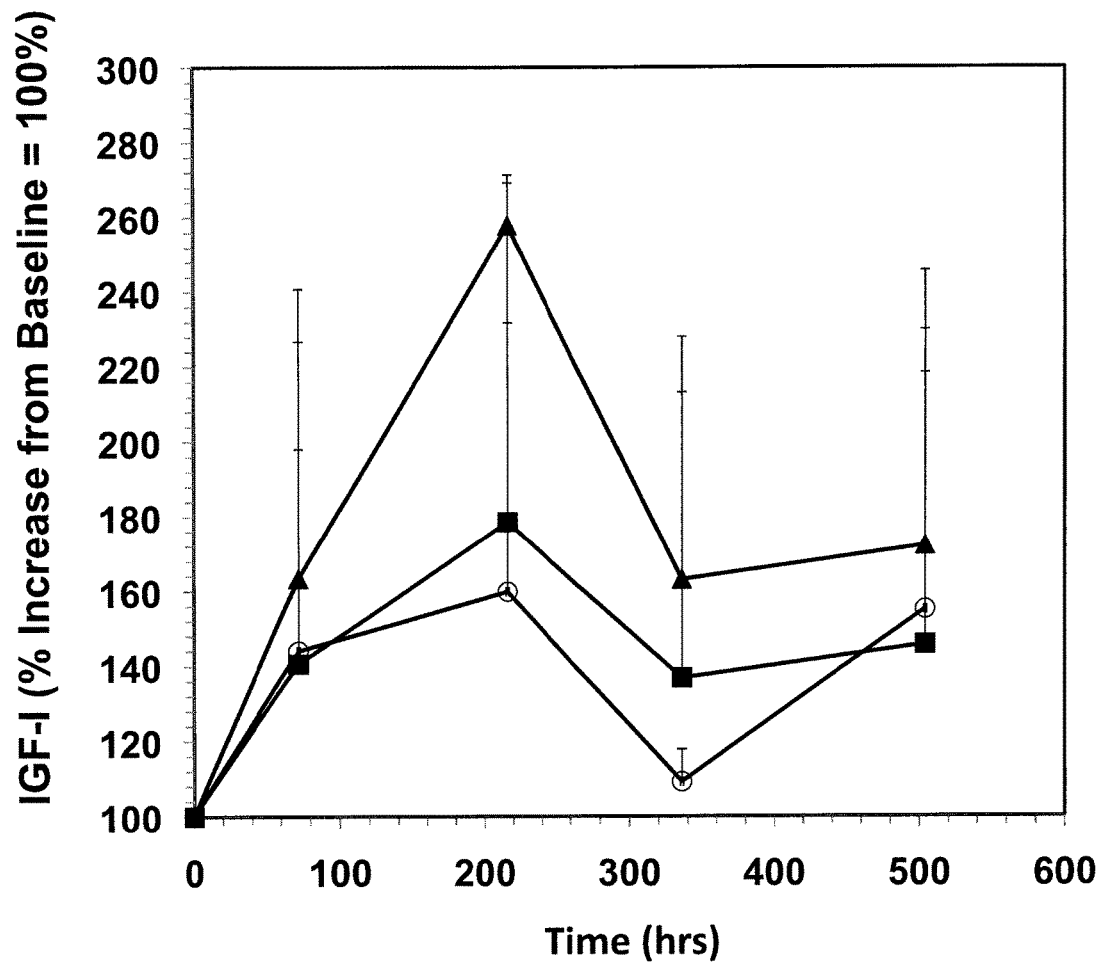
FIG. 30. Shows the results of IGF-1 levels in cynos in response to the administration of AE912-hGH-AE144, as described in Example 33 (same groups as per FIG. 29).

Example 33: Assessment of Pharmacodynamic Effects of AE912-hGH-AE144 GHXTEN by Measurement of IGF-1 Response in Cynomolgus Monkeys AE912-hGH-AE144 was administered to male and female cynos SC at 0.3, 1.5, and 7.5 mg/kg and dose volumes ranging from 0.80 to 1.13 ml. Blood samples (1.0 mL) were collected into prechilled heparinized tubes at predose, 2, 4, 8, 24, 48, 72, 96, 120, 168, 216, 264, 336, 388, 432, 504 hour timepoints (16), and processed into plasma. PK was measured by ELISA assay using the anti-XTEN capture antibody and the biotinylated anti-hGH detection antibody. IGF-1 samples were sent to and analyzed by Millipore. PK parameters were calculated by analysis using the WinNonLin software package and are shown in the table below. Plasma concentration profiles of the three doses of GHXTEN and IGF-1 levels are shown in FIG. 29 and FIG. 30, respectively (open circles=0.3 mg/kg; squares=1.5 mg/kg; triangles=7.5 mg/kg). The results show that administration of AE912-hGH-AE144 results in a sustained increase in IGF-1 levels, consistent with both the biological mode of action of growth hormone and the long plasma half-life of AE912-hGH-AE144.

TABLE 22

| PK parameters in cynomolgus monkeys | | | |
|---|---|---|---|
| | 0.3 mg/kg | 1.5 mg/kg | 7.5 mg/kg |
| Route | SC | SC | SC |
| T½ (hrs) | 84.4 | 97.5 | 101.1 |
| Cmax (nM) | 41 | 910 | 340 |
| AUC (nM * hr) | 5,170 | 162,000 | 64,100 |

Figure 31:
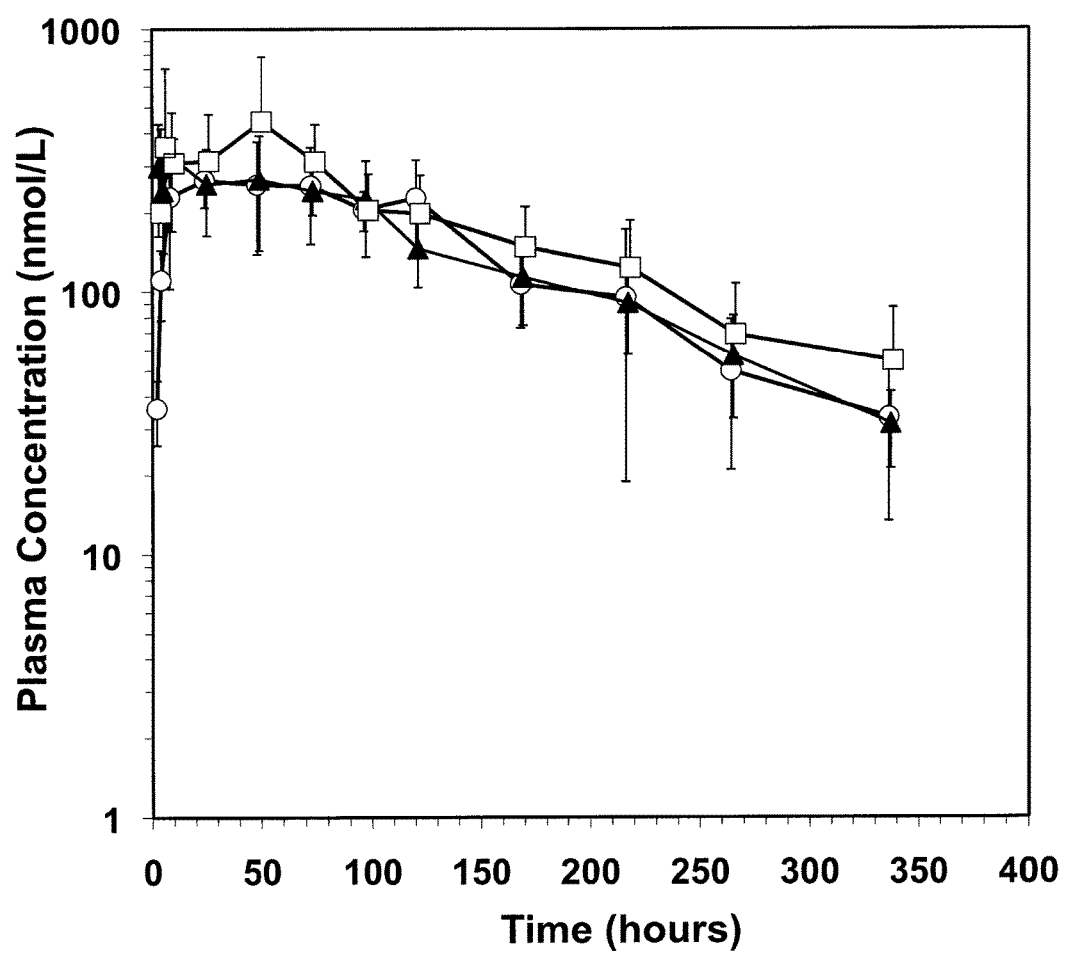
FIG. 31 shows the results of an experiment to compare bioavailability of the GHXTEN AE912-hGH-AE144 administered by three different routes, as described in Example 34. AE912-hGH-AE144 was administered to male and female cynos SC at 1.5 mg/kg via intravenous (triangle), subcutaneous (open circles), and intramuscular (squares) routes, with plasma concentrations of the GHXTEN shown in the figure.

Example 34: Comparative Bioavailability of AE912-hGH-AE144 Via Subcutaneous and Intramuscular Administration to Cynomolgus Monkeys AE912-hGH-AE144 was administered to male and female cynos SC at 1.5 mg/kg via intravenous, subcutaneous, and intramuscular routes. Blood samples (1.0 mL) were collected into prechilled heparinized tubes at predose, 2, 4, 8, 24, 48, 72, 96, 120, 168, 216, 264, 336, 388, 432, 504 hour timepoints (16), and processed into plasma. Plasma levels at each time point were measured by ELISA assay using the anti-XTEN capture antibody and the biotinylated anti-hGH detection antibody. PK and bioavailability parameters were calculated by analysis using the WinNonLin software package and are shown in the table below. Plasma concentration profiles are shown in FIG. 31 (open circles=subcutaneous; triangle=IV; squares=intramuscular). For bioavailability calculations, the AUC for intravenous administration was defined to be 100%. The results show that AE912-hGH-AE144 shows a high bioavailability and distributes rapidly from the injection site to the blood compartment following injection.

TABLE 23

| PK parameters in cynomolgus monkeys | | | |
|---|---|---|---|
| | 1.5 mg/kg | 1.5 mg/kg | 1.5 mg/kg |
| Route | SC | IV | IM |
| T½ (hrs) | 97.5 | 107.7 | 102.2 |
| Cmax (nM) | 910 | 462 | 245 |
| AUC (nM * hr) | 162,000 | 60,300 | 43,200 |
| Bioavailability | ~100% | 100% | 72% |

Example 35: Determination of the Therapeutic Window for AE912-hGH-AE144

Figure 32:
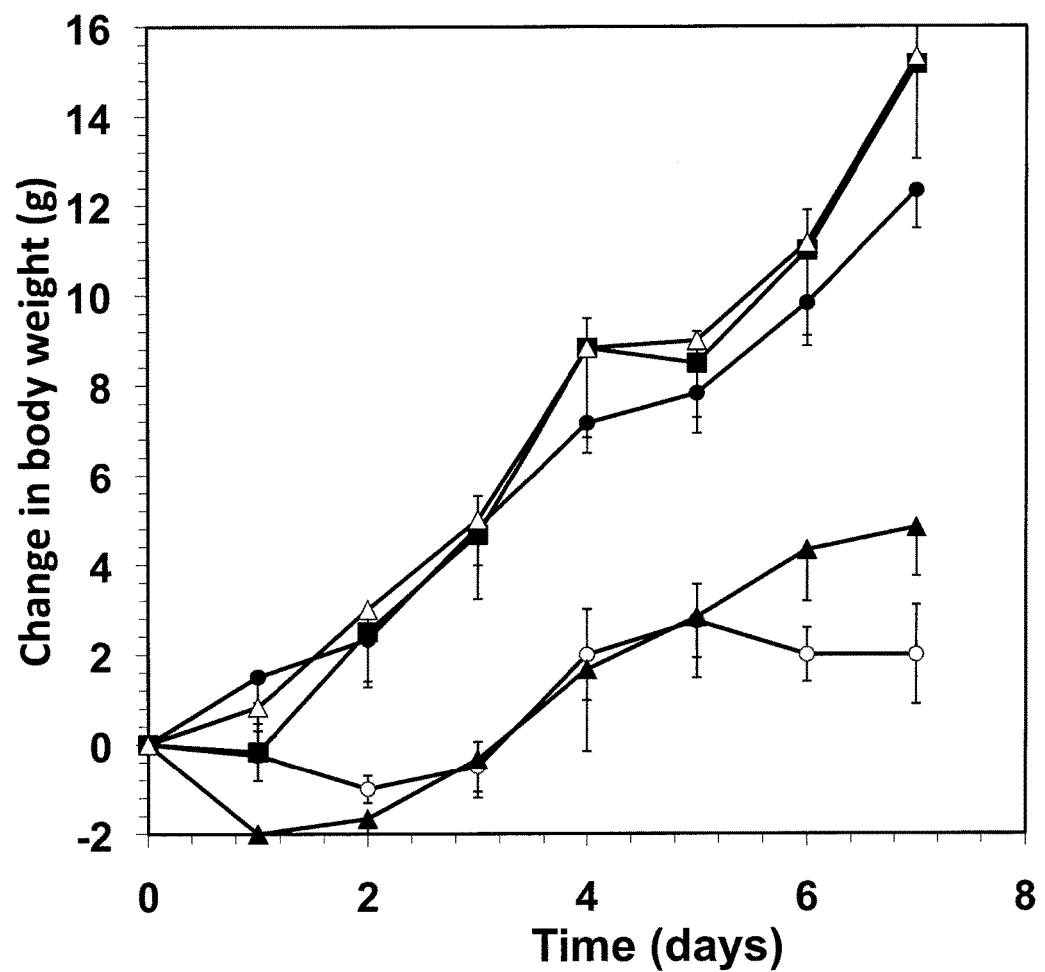
FIG. 32 shows the effects of administration of vehicle (open circles), recombinant hGH dosed at 5 nmol/kg/day (closed circles), the GHXTEN AE912-hGH-AE144 at varying doses and dose frequency (closed triangles=0.5 nmol/kg/day; open triangles=1.5 nmol/day; squares=3 nmol/kg/Q2D) on body weight in hypox rats, as described in Example 35.
Figure 33:
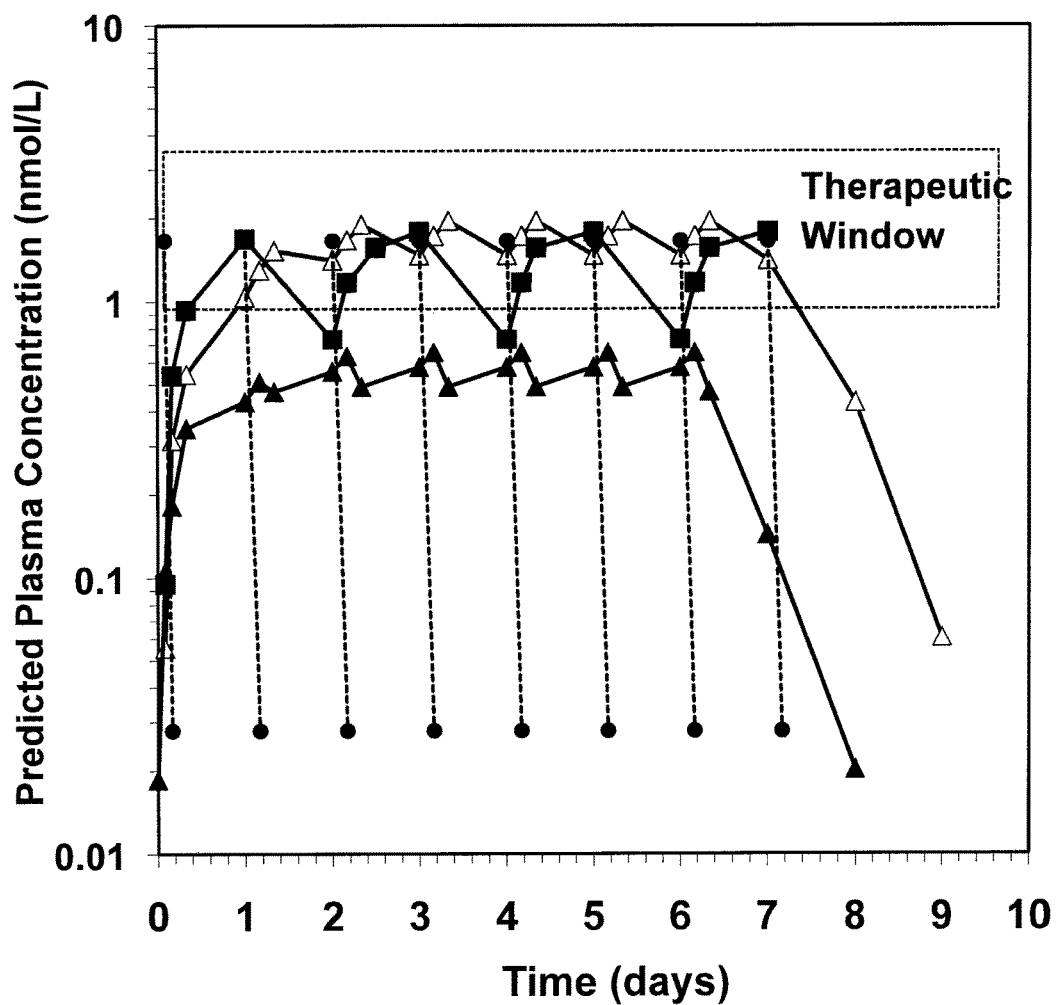
FIG. 33 shows results of a modeled projection of the ability of hGH or the GHXTEN to maintain blood levels within a therapeutic window in the hypox rat model, based on results derived from the data portrayed in FIG. 32, using the same dosing groups.

The specific activity of the GHXTEN AE912-hGH-AE144 was assessed using the measured parameter of body weight gain in a hypophysectomized (hypox) rat in response to administered compound. FIG. 32 shows the effects of administration of vehicle (open circles), recombinant hGH dosed at 5 nmol/kg/day (closed circles), the GHXTEN AE912-hGH-AE144 at varying doses and dose frequency (closed triangles=0.5 nmol/kg/day; open triangles=1.5 nmol/kg/day; squares=3 nmol/kg/Q2D) on body weight in hypox rats. The results show that a dose of the GHXTEN AE912-hGH-AE144 as low as 1.5 nmol/kg/day yields comparable growth to hGH alone. However, a lower dose of 0.5 nmol/kg/day does not promote growth in these animals. Based on the pharmacokinetic profiles determined in the rats, a model for plasma levels following repeat dosing was constructed as shown in FIG. 33 (same groups as per FIG. 32). The model clearly differentiates the efficacious doses from the non-efficacious lower dose. The results show that plasma concentration of AE912-hGH-AE144 generally should remain above about 1 nmol/L concentration in order to maintain optimal growth in the hypophysectomized rat model.

Example 36: Human Clinical Trial Designs for Evaluating GHXTEN

Clinical trials can be designed such that the efficacy and advantages of the GHXTEN compositions, relative to the corresponding growth hormone biologics, can be verified in humans. For example, the GHXTEN fusion constructs comprising growth, as described in the Examples above, can be used in clinical trials for characterizing the efficacy of the compositions. The trials can be conducted in one or more growth hormone-related diseases, disorders, or conditions that are improved, ameliorated, or inhibited by the administration of growth hormone. Such studies in adult patients comprise three phases. First, a Phase I safety and pharmacokinetics study in adult patients is conducted to determine the maximum tolerated dose and pharmacokinetics and pharmacodynamics in humans (either normal subjects or patients with a growth disease or condition), as well as to define potential toxicities and adverse events to be tracked in future studies. The study is conducted in which single rising doses of compositions of fusion proteins of GHXTEN is administered and biochemical, PK, and clinical parameters is measured. This permits the determination of the maximum tolerated dose and establishes the threshold and maximum concentrations in dosage and circulating drug that constitute the therapeutic window for the respective components. Thereafter, clinical trials are conducted in patients with the disease, disorder or condition.

Phase II and III Clinical Trials

A phase II dosing study is conducted in patients where blood growth hormone pharmacodynamics and other physiologic, PK, safety and clinical parameters (such as listed below) appropriate for trials, such as for reversal of short stature due to GH deficiency in pediatric patients, treatment of Turner syndrome, chronic renal failure, Prader-Willi syndrome, intrauterine growth retardation, or improvements in body mass composition (increase in lean body mass, decrease in fat mass) in adult patients (such as HIV+ or acquired pituitary tumor patients). Parameters and clinical endpoints are measured as a function of the dosing of the fusion proteins compositions, yielding dose-ranging information on doses that would be appropriate for a subsequent Phase III trial, in addition to collecting safety data related to adverse events. The PK parameters are correlated to the physiologic, clinical and safety parameter data to establish the therapeutic window and the therapeutic dose regimen for the GHXTEN composition, permitting the clinician to establish the appropriate dose ranges for a GHXTEN composition. Finally, a phase III efficacy study is conducted wherein patients would be administered the GHXTEN composition at the dose regimen, and a positive control (such as a commercially-available, approved growth hormone), or a placebo is administered daily or using other dosing schedule deemed appropriate given the pharmacokinetic and pharmacodynamic properties of the control composition, with all agents administered for an appropriately extended period of time to achieve the study endpoints. Parameters that are monitored include GH, IGF-1 and IGFBP3 concentrations, changes in height velocity, lean body mass, total body fat, trunk fat, parameters associated with insulin resistance syndrome, measurement of division and multiplication rates of chondrocytes, and/or changes in bone density and/or bone growth; parameters that would be tracked relative to the placebo or positive control groups. Efficacy outcomes would be determined using standard statistical methods. Toxicity and adverse event markers are also be followed in this study to verify that the compound is safe when used in the manner described.

Figure 34:
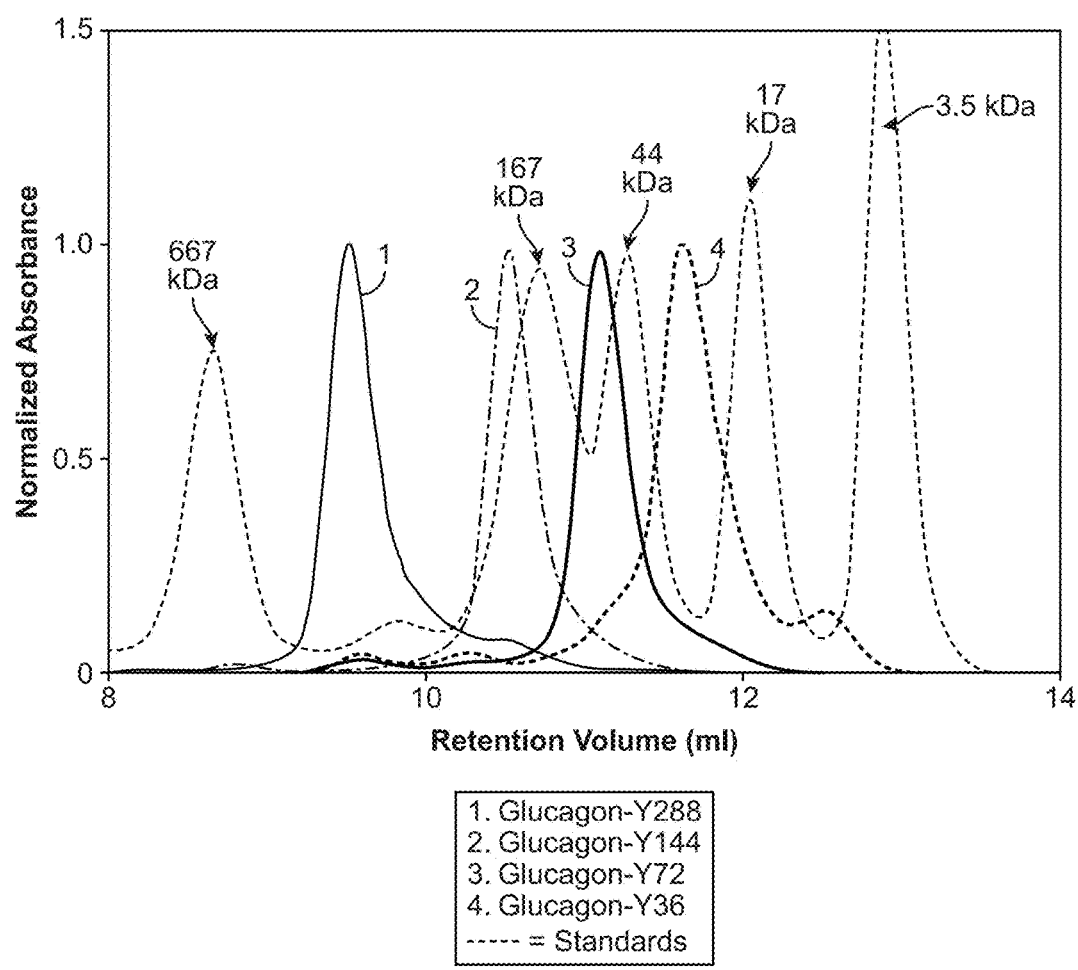
FIG. 34 shows results of a of a size exclusion chromatography analysis of glucagon-XTEN construct samples measured against protein standards of known molecular weight, with the graph output as absorbance versus retention volume, as described in Example 37. The glucagon-XTEN constructs are 1) glucagon-Y288; 2) glucagon Y-144; 3) glucagon-Y72; and 4) glucagon-Y36. The results indicate an increase in apparent molecular weight with increasing length of XTEN moiety.

Example 37: Analytical Size Exclusion Chromatography of XTEN Fusion Proteins with Diverse Payloads Size exclusion chromatography analyses were performed on fusion proteins containing various therapeutic proteins and unstructured recombinant proteins of increasing length. An exemplary assay used a TSKGel-G4000 SWXL (7.8 mm×30 cm) column in which 40 µg of purified glucagon fusion protein at a concentration of 1 mg/ml was separated at a flow rate of 0.6 ml/min in 20 mM phosphate pH 6.8, 114 mM NaCl. Chromatogram profiles were monitored using OD214 nm and OD280 nm. Column calibration for all assays were performed using a size exclusion calibration standard from BioRad; the markers include thyroglobulin (670 kDa), bovine gamma-globulin (158 kDa), chicken ovalbumin (44 kDa), equine myoglobuin (17 kDa) and vitamin B12 (1.35 kDa). Representative chromatographic profiles of Glucagon-Y288, Glucagon-Y144, Glucagon-Y72, Glucagon-Y36 are shown as an overlay in FIG. 34. The data show that the apparent molecular weight of each compound is proportional to the length of the attached XTEN sequence. However, the data also show that the apparent molecular weight of each construct is significantly larger than that expected for a globular protein (as shown by comparison to the standard proteins run in the same assay). Based on the SEC analyses for all constructs evaluated, including a GHXTEN composition, the Apparent Molecular Weights, the Apparent Molecular Weight Factor (expressed as the ratio of Apparent Molecular Weight to the calculated molecular weight) and the hydrodynamic radius ($R_H$ in nm) are shown in Table 24. The results indicate that incorporation of different XTENs of 576 amino acids or greater confers an apparent molecular weight for the fusion protein of approximately 339 kDa to 760, and that XTEN of 864 amino acids or greater confers an apparent molecular weight greater than approximately 800 kDA. The results of proportional increases in apparent molecular weight to actual molecular weight were consistent for fusion proteins created with XTEN from several different motif families; i.e., AD, AE, AF, AG, and AM, with increases of at least four-fold and ratios as high as about 17-fold. Additionally, the incorporation of XTEN fusion partners with 576 amino acids or more into fusion proteins with the various payloads (and 288 residues in the case of glucagon fused to Y288) resulted with a hydrodynamic radius of 7 nm or greater; well beyond the glomerular pore size of approximately 3-5 nm. Accordingly, it is expected that fusion proteins comprising growth and XTEN have reduced renal clearance, contributing to increased terminal half-life and improving the therapeutic or biologic effect relative to a corresponding un-fused biologic payload protein.

TABLE 24

SEC analysis of various polypeptides

| Construct Name | XTEN or fusion partner | Therapeutic Protein | Actual MW (kDa) | Apparent MW (kDa) | Apparent Molecular Weight Factor | $R_H$ (nm) |
| --- | --- | --- | --- | --- | --- | --- |
| AC14 | Y288 | Glucagon | 28.7 | 370 | 12.9 | 7.0 |
| AC28 | Y144 | Glucagon | 16.1 | 117 | 7.3 | 5.0 |
| AC34 | Y72 | Glucagon | 9.9 | 58.6 | 5.9 | 3.8 |
| AC33 | Y36 | Glucagon | 6.8 | 29.4 | 4.3 | 2.6 |
| AC89 | AF120 | Glucagon | 14.1 | 76.4 | 5.4 | 4.3 |
| AC88 | AF108 | Glucagon | 13.1 | 61.2 | 4.7 | 3.9 |
| AC73 | AF144 | Glucagon | 16.3 | 95.2 | 5.8 | 4.7 |
| AC53 | AG576 | GFP | 74.9 | 339 | 4.5 | 7.0 |
| AC39 | AD576 | GFP | 76.4 | 546 | 7.1 | 7.7 |
| AC41 | AE576 | GFP | 80.4 | 760 | 9.5 | 8.3 |
| AC52 | AF576 | GFP | 78.3 | 526 | 6.7 | 7.6 |
| AC85 | AE864 | Exendin-4 | 83.6 | 938 | 11.2 | 8.9 |
| AC114 | AM875 | Exendin-4 | 82.4 | 1344 | 16.3 | 9.4 |
| AC143 | AM875 | hGH | 100.6 | 846 | 8.4 | 8.7 |
| AC227 | AM875 | IL-1ra | 95.4 | 1103 | 11.6 | 9.2 |
| AC228 | AM1318 | IL-1ra | 134.8 | 2286 | 17.0 | 10.5 |

Figure 35:
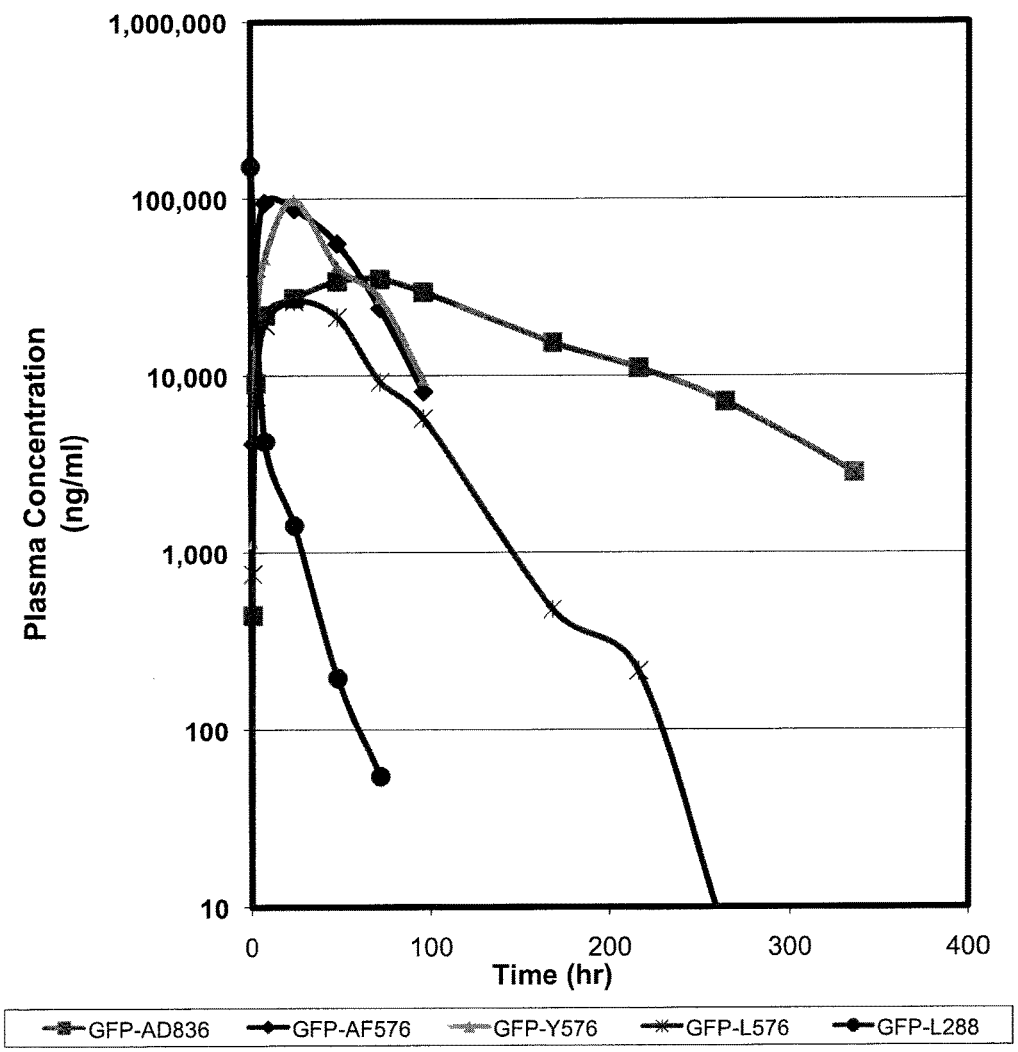
FIG. 35 shows the pharmacokinetic profile (plasma concentrations) in cynomolgus monkeys after single doses of different compositions of GFP linked to unstructured polypeptides of varying length, administered either subcutaneously or intravenously, as described in Example 38. The compositions were GFP-L288, GFP-L576, GFP-XTEN_AF576, GFP-Y576 and XTEN_AD836-GFP. Blood samples were analyzed at various times after injection and the concentration of GFP in plasma was measured by ELISA using a polyclonal antibody against GFP for capture and a biotinylated preparation of the same polyclonal antibody for detection. Results are presented as the plasma concentration versus time (h) after dosing and show, in particular, a considerable increase in half-life for the XTEN_AD836-GFP, the composition with the longest sequence length of XTEN. The construct with the shortest sequence length, the GFP-L288 had the shortest half-life.

Example 38: Pharmacokinetics of Extended Polypeptides Fused to GFP in Cynomolgus Monkeys The pharmacokinetics of GFP-L288, GFP-L576, GFP-XTEN_AF576, GFP-XTEN_Y576 and XTEN_AD836-GFP were tested in cynomolgus monkeys to determine the effect of composition and length of the unstructured polypeptides on PK parameters. Blood samples were analyzed at various times after injection and the concentration of GFP in plasma was measured by ELISA using a polyclonal antibody against GFP for capture and a biotinylated preparation of the same polyclonal antibody for detection. Results are summarized in FIG. 35. They show a surprising increase of half-life with increasing length of the XTEN sequence. For example, a half-life of 10 h was determined for GFP-XTEN_L288 (with 288 amino acid residues in the XTEN). Doubling the length of the unstructured polypeptide fusion partner to 576 amino acids increased the half-life to 20-22 h for multiple fusion protein constructs; i.e., GFP-XTEN_L576, GFP-XTEN_AF576, GFP-XTEN_Y576. A further increase of the unstructured polypeptide fusion partner length to 836 residues resulted in a half-life of 72-75 h for XTEN_AD836-GFP. Thus, increasing the polymer length by 288 residues from 288 to 576 residues increased in vivo half-life by about 10 h. However, increasing the polypeptide length by 260 residues from 576 residues to 836 residues increased half-life by more than 50 h. These results show that there is a surprising threshold of unstructured polypeptide length that results in a greater than proportional gain in in vivo half-life. Thus, fusion proteins comprising extended, unstructured polypeptides are expected to have the property of enhanced pharmacokinetics compared to polypeptides of shorter lengths.

Example 39: Serum Stability of XTEN

Figure 14:
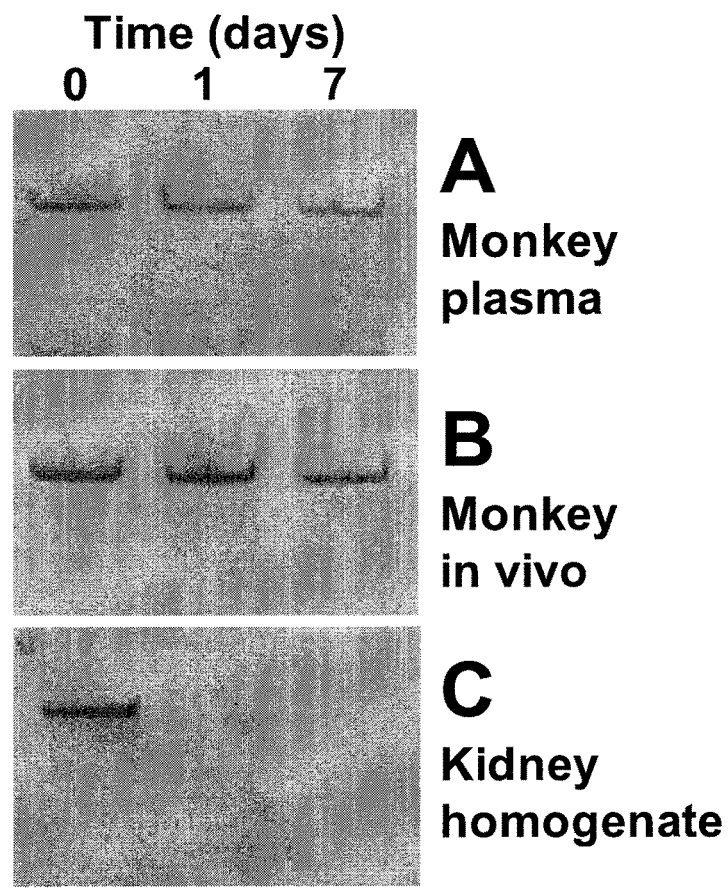
FIG. 14 shows an SDS-PAGE gel of samples from a stability study of the fusion protein of XTEN_AE864 fused to the N-terminus of GFP (see Example 39). The GFP-XTEN was incubated in cynomolgus plasma and rat kidney lysate for up to 7 days at 37° C. In addition, GFP-XTEN administered to cynomolgus monkeys was also assessed. Samples were withdrawn at 0, 1 and 7 days and analyzed by SDS PAGE followed by detection using Western analysis and detection with antibodies against GFP.

A fusion protein containing XTEN_AE864 fused to the N-terminus of GFP was incubated in monkey plasma and rat kidney lysate for up to 7 days at 37° C. Samples were withdrawn at time 0, Day 1 and Day 7 and analyzed by SDS PAGE followed by detection using Western analysis and detection with antibodies against GFP as shown in FIG. 14. The sequence of XTEN_AE864 showed negligible signs of degradation over 7 days in plasma. However, XTEN_AE864 was rapidly degraded in rat kidney lysate over 3 days. The in vivo stability of the fusion protein was tested in plasma samples wherein the GFP_AE864 was immunoprecipitated and analyzed by SDS PAGE as described above. Samples that were withdrawn up to 7 days after injection showed very few signs of degradation. The results demonstrate the resistance of GHXTEN to degradation due to serum proteases; a factor in the enhancement of pharmacokinetic properties of the GHXTEN fusion proteins.

Example 40: PK Analysis of Ex4-XTEN Fusion Protein in Multiple Species and Predicted Human Half-Life To determine the predicted pharmacokinetic profile in humans of a therapeutic protein fused to XTEN, studies were performed using exendin-4 fused to the AE864 XTEN as a single fusion polypeptide. The Ex4-XTEN construct was administered to four different animal species at 0.5-1.0 mg/kg, subcutaneously and intravenously. Serum samples were collected at intervals following administration, with serum concentrations determined using standard methods. The half-life for each species was determined, and is tabulated in Table 25. The results were used to predict the human half-life using allometric scaling of terminal half-life, volume of distribution, and clearance rates based on average body mass. FIG. 36A shows a plot of measured terminal half-life versus body mass in the animal species, with a predicted $T_{1/2}$ in a 75 kg human of 140 h, compared to the reported half-life of exenatide of 2.4 h (Bond, A. Proc (Bayl Univ Med Cent) 19(3): 281-284. (2006)). FIG. 36B shows measured drug clearance versus body mass, with a predicted clearance rate value of 30 ml/h in a 75 kg human FIG. 36C shows measured volume of distribution versus body mass, with a predicted value of 5970 ml in a 75 kg human.

Conclusions:

It can be concluded from the results that addition of an XTEN to a glucose-regulating peptide, such as exendin-4, can greatly increase the terminal half-life compared to peptide not linked to XTEN.

TABLE 25

Half-life of Ex4-XTEN

| Species | Half-Life (hr) |
| --- | --- |
| Mouse | 13.5 |
| Rat | 31.7 |
| Monkey | 60.7 |
| Dog | 72.8 |
| Human | 140* |

*Predicted value based on allometric scaling

Example 41: Increasing Solubility and Stability of a Peptide Payload by Linking to XTEN In order to evaluate the ability of XTEN to enhance the physical/chemical properties of solubility and stability, fusion proteins of glucagon plus shorter-length XTEN were prepared and evaluated. The test articles were prepared in Tris-buffered saline at neutral pH and characterization of the Gcg-XTEN solution was by reverse-phase HPLC and size exclusion chromatography to affirm that the protein was homogeneous and non-aggregated in solution. The data are presented in Table 26. For comparative purposes, the solubility limit of unmodified glucagon in the same buffer was measured at 60 µM (0.2 mg/mL), and the result demonstrate that for all lengths of XTEN added, a substantial increase in solubility was attained. Importantly, in most cases the glucagon-XTEN fusion proteins were prepared to achieve target concentrations and were not evaluated to determine the maximum solubility limits for the given construct. However, in the case of glucagon linked to the AF-144 XTEN, the limit of solubility was determined, with the result that a 60-fold increase in solubility was achieved, compared to glucagon not linked to XTEN. In addition, the glucagon-AF144 GHXTEN was evaluated for stability, and was found to be stable in liquid formulation for at least 6 months under refrigerated conditions and for approximately one month at 37° C. (data not shown).

Conclusions:

The data support the conclusion that the linking of short-length XTEN polypeptides to a biologically active protein such as glucagon can markedly enhance the solubility properties of the protein by the resulting fusion protein, as well as confer stability at the higher protein concentrations.

TABLE 26

Solubility of Glucagon-XTEN constructs

| Test Article | Solubility |
| --- | --- |
| Glucagon | 60 µM |
| Glucagon-Y36 | >370 µM |
| Glucagon-Y72 | >293 µM |
| Glucagon-AF108 | >145 µM |
| Glucagon-AF120 | >160 µM |
| Glucagon-Y144 | >497 µM |
| Glucagon-AE144 | >467 µM |
| Glucagon-AF144 | >3600 µM |
| Glucagon-Y288 | >163 µM |

Example 42: Characterization of XTEN Fusion Protein Secondary Structure

Figure 37:
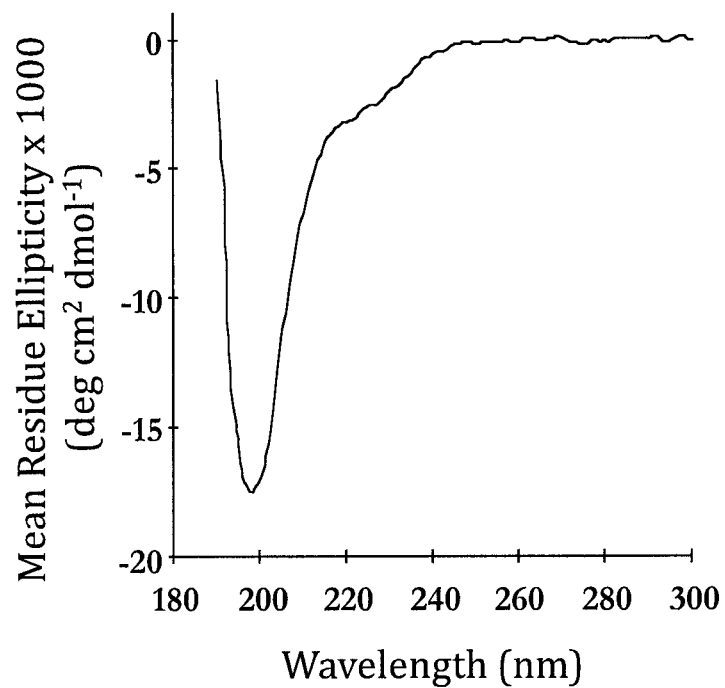
FIG. 37 shows the near UV circular dichroism spectrum of Ex4-XTEN_AE864, performed as described in Example 42.

The fusion protein Ex4-AE864 was evaluated for degree of secondary structure by circular dichroism spectroscopy. CD spectroscopy was performed on a Jasco J-715 (Jasco Corporation, Tokyo, Japan) spectropolarimeter equipped with Jasco Peltier temperature controller (TPC-348WI). The concentration of protein was adjusted to 0.2 mg/mL in 20 mM sodium phosphate pH 7.0, 50 mM NaCl. The experiments were carried out using HELLMA quartz cells with an optical path-length of 0.1 cm. The CD spectra were acquired at 5°, 25°, 45°, and 65° C. and processed using the J-700 version 1.08.01 (Build 1) Jasco software for Windows. The samples were equilibrated at each temperature for 5 min before performing CD measurements. All spectra were recorded in duplicate from 300 nm to 185 nm using a bandwidth of 1 nm and a time constant of 2 sec, at a scan speed of 100 nm/min. The CD spectrum shown in FIG. 37 shows no evidence of stable secondary structure and is consistent with an unstructured polypeptide.

Example 43: Analysis of Sequences for Secondary Structure by Prediction Algorithms Amino acid sequences can be assessed for secondary structure via certain computer programs or algorithms, such as the well-known Chou-Fasman algorithm (Chou, P. Y., et al. (1974) *Biochemistry*, 13: 222-45) and the Garnier-Osguthorpe-Robson, or "GOR" method (Garnier J, Gibrat J F, Robson B. (1996). GOR method for predicting protein secondary structure from amino acid sequence. Methods Enzymol 266:540-553). For a given sequence, the algorithms can predict whether there exists some or no secondary structure at all, expressed as total and/or percentage of residues of the sequence that form, for example, alpha-helices or beta-sheets or the percentage of residues of the sequence predicted to result in random coil formation.

Several representative sequences from XTEN "families" have been assessed using two algorithm tools for the Chou-Fasman and GOR methods to assess the degree of secondary structure in these sequences. The Chou-Fasman tool was provided by William R Pearson and the University of Virginia, at the "Biosupport" internet site, URL located on the World Wide Web at .fasta.bioch.virginia.edu/fasta_www2/fasta_www.cgi?rm=misc1 as it existed on Jun. 19, 2009. The GOR tool was provided by Pole Informatique Lyonnais at the Network Protein Sequence Analysis internet site, URL located on the World Wide Web at .npsa-pbil.ibcp.fr/cgi-bin/secpred_gor4.pl as it existed on Jun. 19, 2008.

As a first step in the analyses, a single XTEN sequence was analyzed by the two algorithms. The AE864 composition is a XTEN with 864 amino acid residues created from multiple copies of four 12 amino acid sequence motifs consisting of the amino acids G, S, T, E, P, and A. The sequence motifs are characterized by the fact that there is limited repetitiveness within the motifs and within the overall sequence in that the sequence of any two consecutive amino acids is not repeated more than twice in any one 12 amino acid motif, and that no three contiguous amino acids of full-length the XTEN are identical. Successively longer portions of the AF 864 sequence from the N-terminus were analyzed by the Chou-Fasman and GOR algorithms (the latter requires a minimum length of 17 amino acids). The sequences were analyzed by entering the FASTA format sequences into the prediction tools and running the analysis. The results from the analyses are presented in Table 27.

The results indicate that, by the Chou-Fasman calculations, the four motifs of the AE family (Table 1) have no alpha-helices or beta sheets. The sequence up to 288 residues was similarly found to have no alpha-helices or beta sheets. The 432 residue sequence is predicted to have a small amount of secondary structure, with only 2 amino acids contributing to an alpha-helix for an overall percentage of 0.5%. The full-length AF864 polypeptide has the same two amino acids contributing to an alpha-helix, for an overall percentage of 0.2%. Calculations for random coil formation revealed that with increasing length, the percentage of random coil formation increased. The first 24 amino acids of the sequence had 91% random coil formation, which increased with increasing length up to the 99.77% value for the full-length sequence.

Numerous XTEN sequences of 500 amino acids or longer from the other motif families were also analyzed and revealed that the majority had greater than 95% random coil formation. The exceptions were those sequences with one or more instances of three contiguous serine residues, which resulted in predicted beta-sheet formation. However, even these sequences still had approximately 99% random coil formation.

In contrast, a polypeptide sequence of 84 residues limited to A, S, and P amino acids was assessed by the Chou-Fasman algorithm, which predicted a high degree of predicted alpha-helices. The sequence, which had multiple repeat "AA" and "AAA" sequences, had an overall predicted percentage of alpha-helix structure of 69%. The GOR algorithm predicted 78.57% random coil formation; far less than any sequence consisting of 12 amino acid sequence motifs consisting of the amino acids G, S, T, E, P, analyzed in the present Example.

Conclusions:

The analysis supports the conclusion that: 1) XTEN created from multiple sequence motifs of G, S, T, E, P, and A that have limited repetitiveness as to contiguous amino acids are predicted to have very low amounts of alpha-helices and beta-sheets; 2) that increasing the length of the XTEN does not appreciably increase the probability of alpha-helix or beta-sheet formation; and 3) that progressively increasing the length of the XTEN sequence by addition of non-repetitive 12-mers consisting of the amino acids G, S, T, E, P, and A results in increased percentage of random coil formation. In contrast, polypeptides created from amino acids limited to A, S and P that have a higher degree of internal repetitiveness are predicted to have a high percentage of alpha-helices, as determined by the Chou-Fasman algorithm, as well as random coil formation. Based on the numerous sequences evaluated by these methods, it is concluded that XTEN created from sequence motifs of G, S, T, E, P, and A that have limited repetitiveness (defined as no more than two identical contiguous amino acids in any one motif) greater than about 400 amino acid residues in length are expected to have very limited secondary structure. With the exception of motifs containing three contiguous serines, it is believed that any order or combination of sequence motifs from Table 1 can be used to create an XTEN polypeptide of a length greater than about 400 residues that will result in an XTEN sequence that is substantially devoid of secondary structure. Such sequences are expected to have the characteristics described in the GHXTEN embodiments of the invention disclosed herein.

TABLE 27

CHOU-FASMAN and GOR prediction calculations of polypeptide sequences

| SEQ NAME | Sequence | SEQ ID NO: | No. Residues | Chou-Fasman Calculation | GOR Calculation |
|---|---|---|---|---|---|
| | GSTSESPSGTAP | 624 | 12 | Residue totals*: H: 0 E: 0<br>percent: H: 0.0 E: 0.0 | Not Determined |
| | GTS TPESGSASP | 625 | 12 | Residue totals: H: 0 E: 0<br>percent: H: 0.0 E: 0.0 | Not Determined |
| | GTSPSGESSTAP | 626 | 12 | Residue totals: H: 0 E: 0<br>percent: H: 0.0 E: 0.0 | Not Determined |
| | GSTSSTAESPGP | 627 | 12 | Residue totals: H: 0 E: 0<br>percent: H: 0.0 E: 0.0 | Not Determined |
| | GSPAGSPTSTEEGTSESATPESGP | 628 | 24 | Residue totals: H: 0 E: 0<br>percent: H: 0.0 E: 0.0 | 91.67% |
| | GSPAGSPTSTEEGTSESATPESGPG<br>TSTEPSEGSAP | 629 | 36 | Residue totals: H: 0 E: 0<br>percent: H: 0.0 E: 0.0 | 94.44% |
| | GSPAGSPTSTEEGTSESATPESGPG<br>TSTEPSEGSAPGSPAGSPTSTEE | 630 | 48 | Residue totals: H: 0 E: 0<br>percent: H: 0.0 E: 0.0 | 93.75% |
| | GSPAGSPTSTEEGTSESATPESGPG<br>TSTEPSEGSAPGSPAGSPTSTEEGTS<br>TEPSEGSAP | 631 | 60 | Residue totals: H: 0 E: 0<br>percent: H: 0.0 E: 0.0 | 96.67% |
| | GSPAGSPTSTEEGTSESATPESGPG<br>TSTEPSEGSAPGSPAGSPTSTEEGTS<br>TEPSEGSAPGTSTEPSEGSAPGTSES<br>ATPESGPGSEPATSGSE<br>TPGSEPATSGSETP | 632 | 108 | Residue totals: H: 0 E: 0<br>percent: H: 0.0 E: 0.0 | 97.22% |
| | GSPAGSPTSTEEGTSESATPESGPG<br>TSTEPSEGSAPGSPAGSPTSTEEGTS<br>TEPSEGSAPGTSTEPSEGSAPGTSES<br>ATPESGPGSEPATSGSETPGSEPAT<br>SGSETPGSPAGSPTSTEEGTSESATP<br>ESGPGTSTEPSEGSAPGTSTEPSEGS<br>APGSPAGSPTSTEEGTSTEPSEGSA<br>PGTSTEPSEGSAPGTSESATPESGP<br>GTSTEPSEGSAP | 633 | 216 | Residue totals: H: 0 E: 0<br>percent: H: 0.0 E: 0.0 | 99.07% |
| | GSPAGSPTSTEEGTSESATPESGPG<br>TSTEPSEGSAPGSPAGSPTSTEEGTS<br>TEPSEGSAPGTSTEPSEGSAPGTSES<br>ATPESGPGSEPATSGSETPGSEPAT<br>SGSETPGSPAGSPTSTEEGTSESATP<br>ESGPGTSTEPSEGSAPGTSTEPSEGS<br>APGSPAGSPTSTEEGTSTEPSEGSA<br>PGTSTEPSEGSAPGTSESATPESGP<br>GTSTEPSEGSAPGTSESATPESGPG<br>SEPATSGSETPGTSTEPSEGSAPGTS<br>TEPSEGSAPGTSESATPESGPGTSES | 634 | 432 | Residue totals: H: 2 E: 3<br>percent: H: 0.5 E: 0.7 | 99.54% |

TABLE 27-continued

CHOU-FASMAN and GOR prediction calculations of polypeptide sequences

| SEQ NAME | Sequence | SEQ ID NO: | No. Residues | Chou-Fasman Calculation | GOR Calculation |
|---|---|---|---|---|---|
|  | ATPESGPGSPAGSPTSTEEGTSESA TPESGPGSEPATSGSETPGTSESATP ESGPGTSTEPSEGSAPGTSTEPSEGS APGTSTEPSEGSAPGTSTEPSEGSA PGTSTEPSEGSAPGTSTEPSEGSAP GSPAGSPTSTEEGTSTEPSEGSAP |  |  |  |  |
| AE864 | GSPAGSPTSTEEGTSESATPESGPG TSTEPSEGSAPGSPAGSPTSTEEGTS TEPSEGSAPGTSTEPSEGSAPGTSES ATPESGPGSEPATSGSETPGSEPAT SGSETPGSPAGSPTSTEEGTSESATP ESGPGTSTEPSEGSAPGTSTEPSEGS APGSPAGSPTSTEEGTSTEPSEGSA PGTSTEPSEGSAPGTSESATPESGP GTSTEPSEGSAPGTSESATPESGPG SEPATSGSETPGTSTEPSEGSAPGTS TEPSEGSAPGTSESATPESGPGTSES ATPESGPGSPAGSPTSTEEGTSESA TPESGPGSEPATSGSETPGTSESATP ESGPGTSTEPSEGSAPGTSTEPSEGS APGTSTEPSEGSAPGTSTEPSEGSA PGTSTEPSEGSAPGTSTEPSEGSAP GSPAGSPTSTEEGTSTEPSEGSAPG TSESATPESGPGSEPATSGSETPGTS ESATPESGPGSEPATSGSETPGTSES ATPESGPGTSTEPSEGSAPGTSESA TPESGPGSPAGSPTSTEEGSPAGSPT STEEGSPAGSPTSTEEGTSESATPES GPGTSTEPSEGSAPGTSESATPESG PGSEPATSGSETPGTSESATPESGP GSEPATSGSETPGTSESATPESGPG TSTEPSEGSAPGSPAGSPTSTEEGTS ESATPESGPGSEPATSGSETPGTSES ATPESGPGSPAGSPTSTEEGSPAGS PTSTEEGTSTEPSEGSAPGTSESATP ESGPGTSESATPESGPGTSESATPES GPGSEPATSGSETPGSEPATSGSET PGSPAGSPTSTEEGTSTEPSEGSAP GTSTEPSEGSAPGSEPATSGSETPG TSESATPESGPGTSTEPSEGSAP | 635 | 864 | Residue totals: H: 2 E: 3 percent: H: 0.2 E: 0.3 | 99.77% |
| AD 576 | GSSESGSSEGGPGSGGEPSESGSSG SSESGSSEGGPGSSESGSSEGGPGSS ESGSSEGGPGSSESGSSEGGPGSSE SGSSEGGPGESPGGSSGSESGSEGS SGPGESSGSSESGSSEGGPGSSESGS SEGGPGSSESGSSEGGPGSGGEPSE SGSSGESPGGSSGSESGESPGGSSG SESGSGGEPSESGSSGSSESGSSEG GPGSGGEPSESGSGSGGEPSESGS SGSEGSSGPGESSGESPGGSSGSES GSGGEPSESGSSGSGGEPSESGSSG SGGEPSESGSSGSSESGSSEGGPGE SPGGSSGSESGESPGGSSGSESGESP GGSSGSESGESPGGSSGSESGESPG GSSGSESGSSESGSSEGGPGSGGEP SESGSSGSEGSSGPGESSGSSESGSS EGGPGSGGEPSESGSSGSSESGSSE GGPGSGGEPSESGSSGESPGGSSGS ESGESPGGSSGSESGSSESGSSEGG PGSGGEPSESGSSGSSESGSSEGGP GSGGEPSESGSSGSGGEPSESGSSG ESPGGSSGSESGSEGSSGPGESSGSS ESGSSEGGPGSEGSSGPGESS | 636 | 576 | Residue totals: H: 7 E: 0 percent: H: 1.2 E: 0.0 | 99.65% |
| AE576 | GSPAGSPTSTEEGTSESATPESGPG TSTEPSEGSAPGSPAGSPTSTEEGTS TEPSEGSAPGTSTEPSEGSAPGTSES ATPESGPGSEPATSGSETPGSEPAT SGSETPGSPAGSPTSTEEGTSESATP ESGPGTSTEPSEGSAPGTSTEPSEGS APGSPAGSPTSTEEGTSTEPSEGSA PGTSTEPSEGSAPGTSESATPESGP GTSTEPSEGSAPGTSESATPESGPG | 637 | 576 | Residue totals: H: 2 E: 0 percent: H: 0.4 E: 0.0 | 99.65% |

TABLE 27-continued

CHOU-FASMAN and GOR prediction calculations of polypeptide sequences

| SEQ NAME | Sequence | SEQ ID NO: | No. Residues | Chou-Fasman Calculation | GOR Calculation |
|---|---|---|---|---|---|
| | SEPATSGSETPGTSTEPSEGSAPGTS TEPSEGSAPGTSESATPESGPGTSES ATPESGPGSPAGSPTSTEEGTSESA TPESGPGSEPATSGSETPGTSESATP ESGPGTSTEPSEGSAPGTSTEPSEGS APGTSTEPSEGSAPGTSTEPSEGSA PGTSTEPSEGSAPGTSTEPSEGSAP GSPAGSPTSTEEGTSTEPSEGSAPG TSESATPESGPGSEPATSGSETPGTS ESATPESGPGSEPATSGSETPGTSES ATPESGPGTSTEPSEGSAPGTSESA TPESGPGSPAGSPTSTEEGSPAGSPT STEEGSPAGSPTSTEEGTSESATPES GPGTSTEPSEGSAP | | | | |
| AF540 | GSTSSTAESPGPGSTSSTAESPGPGS TSESPSGTAPGSTSSTAESPGPGSTS STAESPGPGTSTPESGSASPGSTSES PSGTAPGTSPSGESSTAPGSTSESPS GTAPGSTSESPSGTAPGTSPSGESST APGSTSESPSGTAPGSTSESPSGTAP GTSPSGESSTAPGSTSESPSGTAPGS TSESPSGTAPGSTSESPSGTAPGTST PESGSASPGSTSESPSGTAPGTSTPE SGSASPGSTSSTAESPGPGSTSSTAE SPGPGTSTPESGSASPGTSTPESGSA SPGSTSESPSGTAPGTSTPESGSASP GTSTPESGSASPGSTSESPSGTAPGS TSESPSGTAPGSTSESPSGTAPGSTS STAESPGPGTSTPESGSASPGTSTPE SGSASPGSTSESPSGTAPGSTSESPS GTAPGTSTPESGSASPGSTSESPSGT APGSTSESPSGTAPGTSTPESGSASP GTSPSGESSTAPGSTSSTAESPGPGT SPSGESSTAPGSTSSTAESPGPGTST PESGSASPGSTSESPSGTAP | 638 | 540 | Residue totals: H: 2 E: 0 percent: H: 0.4 E: 0.0 | 99.65 |
| AF504 | GASPGTSSTGSPGSSPSASTGTGPG SSPSASTGTGPGTPGSGTASSSPGSS TPSGATGSPGSNPSASTGTGPGASP GTSSTGSPGTPGSGTASSSPGSSTPS GATGSPGTPGSGTASSSPGASPGTS STGSPGASPGTSSTGSPGTPGSGTA SSSPGSSTPSGATGSPGASPGTSSTG SPGTPGSGTASSSPGSSTPSGATGSP GSNPSASTGTGPGSSPSASTGTGPG SSTPSGATGSPGSSTPSGATGSPGA SPGTSSTGSPGASPGTSSTGSPGASP GTSSTGSPGTPGSGTASSSPGASPG TSSTGSPGASPGTSSTGSPGASPGT SSTGSPGSSPSASTGTGPGTPGSGT ASSSPGASPGTSSTGSPGASPGTSST GSPGASPGTSSTGSPGSSTPSGATG SPGSSTPSGATGSPGASPGTSSTGSP GTPGSGTASSSPGSSTPSGATGSPG SSTPSGATGSPGSSTPSGATGSPGSS PSASTGTGPGASPGTSSTGSP | 639 | 504 | Residue totals: H: 0 E: 0 percent: H: 0.0 E: 0.0 | 94.44% |
| AE864 | GSPAGSPTSTEEGTSESATPESGPG TSTEPSEGSAPGSPAGSPTSTEEGTS TEPSEGSAPGTSTEPSEGSAPGTSES ATPESGPGSEPATSGSETPGSEPAT SGSETPGSPAGSPTSTEEGTSESATP ESGPGTSTEPSEGSAPGTSTEPSEGS APGSPAGSPTSTEEGTSTEPSEGSA PGTSTEPSEGSAPGTSESATPESGP GTSTEPSEGSAPGTSESATPESGPG SEPATSGSETPGTSTEPSEGSAPGTS TEPSEGSAPGTSESATPESGPGTSES ATPESGPGSPAGSPTSTEEGTSESA TPESGPGSEPATSGSETPGTSESATP ESGPGTSTEPSEGSAPGTSTEPSEGS APGTSTEPSEGSAPGTSTEPSEGSA PGTSTEPSEGSAPGTSTEPSEGSAP GSPAGSPTSTEEGTSTEPSEGSAPG | 640 | 864 | Residue totals: H: 2 E: 3 percent: H: 0.2 E: 0.4 | 99.77% |

TABLE 27-continued

CHOU-FASMAN and GOR prediction calculations of polypeptide sequences

| SEQ NAME | Sequence | SEQ ID NO: | No. Residues | Chou-Fasman Calculation | GOR Calculation |
|---|---|---|---|---|---|
| | TSESATPESGPGSEPATSGSETPGTS ESATPESGPGSEPATSGSETPGTSES ATPESGPGTSTEPSEGSAPGTSESA TPESGPGSPAGSPTSTEEGSPAGSPT STEEGSPAGSPTSTEEGTSESATPES GPGTSTEPSEGSAPGTSESATPESG PGSEPATSGSETPGTSESATPESGP GSEPATSGSETPGTSESATPESGPG TSTEPSEGSAPGSPAGSPTSTEEGTS ESATPESGPGSEPATSGSETPGTSES ATPESGPGSPAGSPTSTEEGSPAGS PTSTEEGTSTEPSEGSAPGTSESATP ESGPGTSESATPESGPGTSESATPES GPGSEPATSGSETPGSEPATSGSET PGSPAGSPTSTEEGTSTEPSEGSAP GTSTEPSEGSAPGSEPATSGSETPG TSESATPESGPGTSTEPSEGSAP | | | | |
| AF864 | GSTSESPSGTAPGTSPSGESSTAPGS TSESPSGTAPGSTSESPSGTAPGTST PESGSASPGTSTPESGSASPGSTSES PSGTAPGSTSESPSGTAPGTSPSGES STAPGSTSESPSGTAPGTSPSGESST APGTSPSGESSTAPGSTSSTAESPGP GTSPSGESSTAPGTSPSGESSTAPGS TSSTAESPGPGTSTPESGSASPGTST PESGSASPGTSESPSGTAPGSTSES PSGTAPGTSTPESGSASPGSTSSTAE SPGPGTSTPESGSASPGSTSESPSGT APGTSPSGESSTAPGSTSSTAESPGP GTSPSGESSTAPGTSTPESGSASPGS TSSTAESPGPGSTSSTAESPGPGSTS STAESPGPGSTSSTAESPGPGTSPSG ESSTAPGSTSESPSGTAPGSTSESPS GTAPGTSTPESGPXXXGASASGAP STXXXXSESPSGTAPGSTSESPSGT APGSTSESPSGTAPGSTSESPSGTAP GSTSESPSGTAPGSTSESPSGTAPGT STPESGSASPGTSPSGESSTAPGTSP SGESSTAPGSTSSTAESPGPGTSPSG ESSTAPGTSTPESGSASPGSTSESPS GTAPGSTSESPSGTAPGTSPSGESST APGSTSESPSGTAPGTSTPESGSASP GTSTPESGSASPGSTSESPSGTAPGT STPESGSASPGSTSSTAESPGPGSTS ESPSGTAPGSTSESPSGTAPGTSPSG ESSTAPGSTSSTAESPGPGTSPSGES STAPGTSTPESGSASPGTSPSGESST APGSTSPSGESSTAPGTSPSGESSTAP GSTSSTAESPGPGSTSSTAESPGPGT SPSGESSTAPGSSPSASTGTGPGSST PSGATGSPGSSTPSGATGSP | 641 | 875 | Residue totals: H: 2 E: 0 percent: H: 0.2 E: 0.0 | 95.20% |
| AG864 | GGSPGASPGTSSTGSPGSSPSASTG TGPGSSPSASTGTGPGTPGSGTASS SPGSSTPSGATGSPGSNPSASTGTG PGASPGTSSTGSPGTPGSGTASSSP GSSTPSGATGSPGTPGSGTASSSPG ASPGTSSTGSPGASPGTSSTGSPGT PGSGTASSSPGSSTPSGATGSPGAS PGTSSTGSPGTPGSGTASSSPGSSTP SGATGSPGSNPSASTGTGPGSSPSA STGTGPGSSTPSGATGSPGSSTPSG ATGSPGASPGTSSTGSPGASPGTSS TGSPGASPGTSSTGSPGTPGSGTAS SSPGASPGTSSTGSPGASPGTSSTGS PGASPGTSSTGSPGSSPSASTGTGP GTPGSGTASSSPGASPGTSSTGSPG ASPGTSSTGSPGASPGTSSTGSPGSS TPSGATGSPGSSTPSGATGSPGASP GTSSTGSPGTPGSGTASSSPGSSTPS GATGSPGSSTPSGATGSPGSSTPSG ATGSPGSSPSASTGTGPGASPGTSS TGSPGASPGTSSTGSPGTPGSGTAS SSPGASPGTSSTGSPGASPGTSSTGS | 642 | 868 | Residue totals: H: 0 E: 0 percent: H: 0.0 E: 0.0 | 94.70% |

TABLE 27-continued

CHOU-FASMAN and GOR prediction calculations of polypeptide sequences

| SEQ NAME | Sequence | SEQ ID NO: | No. Residues | Chou-Fasman Calculation | GOR Calculation |
|---|---|---|---|---|---|
| | PGASPGTSSTGSPGASPGTSSTGSP<br>GTPGSGTASSSPGSSTPSGATGSPG<br>TPGSGTASSSPGSSTPSGATGSPGT<br>PGSGTASSSPGSSTPSGATGSPGSST<br>PSGATGSPGSSPSASTGTGPGSSPS<br>ASTGTGPGASPGTSSTGSPGTPGSG<br>TASSSPGSSTPSGATGSPGSSPSAST<br>GTGPGSSPSASTGTGPGASPGTSST<br>GSPGASPGTSSTGSPGSSTPSGATG<br>SPGSSPSASTGTGPGASPGTSSTGSP<br>GSSPSASTGTGPGTPGSGTASSSPG<br>SSTPSGATGSPGSSTPSGATGSPGA<br>SPGTSSTGSP | | | | |
| AM875 | GTSTEPSEGSAPGSEPATSGSETPG<br>SPAGSPTSTEEGSTSSTAESPGPGTS<br>TPESGSASPGSTSESPSGTAPGSTSE<br>SPSGTAPGTSTPESGSASPGTSTPES<br>GSASPGSEPATSGSETPGTSESATP<br>ESGPGSPAGSPTSTEEGTSTEPSEGS<br>APGTSESATPESGPGTSTEPSEGSA<br>PGTSTEPSEGSAPGSPAGSPTSTEE<br>GTSTEPSEGSAPGTSTEPSEGSAPG<br>TSESATPESGPGTSESATPESGPGTS<br>TEPSEGSAPGTSTEPSEGSAPGTSES<br>ATPESGPGTSTEPSEGSAPGSEPAT<br>SGSETPGSPAGSPTSTEEGSSTPSGA<br>TGSPGTPGSGTASSSPGSSTPSGAT<br>GSPGTSTEPSEGSAPGTSTEPSEGS<br>APGSEPATSGSETPGSPAGSPTSTE<br>EGSPAGSPTSTEEGTSTEPSEGSAP<br>GASASGAPSTGGTSESATPESGPGS<br>PAGSPTSTEEGSPAGSPTSTEEGSTS<br>STAESPGPGSTSESPSGTAPGTSPSG<br>ESSTAPGTPGSGTASSSPGSSTPSG<br>ATGSPGSSPSASTGTGPGSEPATSG<br>SETPGTSESATPESGPGSEPATSGSE<br>TPGSTSSTAESPGPGSTSSTAESPGP<br>GTSPSGESSTAPGSEPATSGSETPGS<br>EPATSGSETPGTSTEPSEGSAPGSTS<br>STAESPGPGTSTPESGSASPGSTSES<br>PSGTAPGTSTEPSEGSAPGTSTEPSE<br>GSAPGTSTEPSEGSAPGSSTPSGAT<br>GSPGSSPSASTGTGPGASPGTSSTG<br>SPGSEPATSGSETPGTSESATPESGP<br>GSPAGSPTSTEEGSSTPSGATGSPG<br>SSPSASTGTGPGASPGTSSTGSPGT<br>SESATPESGPGTSTEPSEGSAPGTST<br>EPSEGSAP | 643 | 875 | Residue totals: H: 7 E: 3<br>percent: H: 0.8 E: 0.3 | 98.63% |
| AM1318 | GTSTEPSEGSAPGSEPATSGSETPG<br>SPAGSPTSTEEGSTSSTAESPGPGTS<br>TPESGSASPGSTSESPSGTAPGSTSE<br>SPSGTAPGTSTPESGSASPGTSTPES<br>GSASPGSEPATSGSETPGTSESATP<br>ESGPGSPAGSPTSTEEGTSTEPSEGS<br>APGTSESATPESGPGTSTEPSEGSA<br>PGTSTEPSEGSAPGSPAGSPTSTEE<br>GTSTEPSEGSAPGTSTEPSEGSAPG<br>TSESATPESGPGTSESATPESGPGTS<br>TEPSEGSAPGTSTEPSEGSAPGTSES<br>ATPESGPGTSTEPSEGSAPGSEPAT<br>SGSETPGSPAGSPTSTEEGSSTPSGA<br>TGSPGTPGSGTASSSPGSSTPSGAT<br>GSPGTSTEPSEGSAPGTSTEPSEGS<br>APGSEPATSGSETPGSPAGSPTSTE<br>EGSPAGSPTSTEEGTSTEPSEGSAP<br>GPEPTGPAPSGGSEPATSGSETPGT<br>SESATPESGPGSPAGSPTSTEEGTSE<br>SATPESGPSPAGSPTSTEEGSPAG<br>SPTSTEEGTSESATPESGPGSPAGSP<br>TSTEEGSPAGSPTSTEEGSTSSTAES<br>PGPGSTSESPSGTAPGTSPSGESSTA<br>PGSTSESPSGTAPGTSESPSGTAPG<br>TSPSGESSTAPGTSTEPSEGSAPGTS | 644 | 1318 | Residue totals: H: 7 E: 0<br>percent: H: 0.7 E: 0.0 | 99.17% |

TABLE 27-continued

CHOU-FASMAN and GOR prediction calculations of polypeptide sequences

| SEQ NAME | Sequence | SEQ ID NO: | No. Residues | Chou-Fasman Calculation | GOR Calculation |
|---|---|---|---|---|---|
| | ESATPESGPGTSESATPESGPGSEP<br>ATSGSETPGTSESATPESGPGTSES<br>ATPESGPGTSTEPSEGSAPGTSESA<br>TPESGPGTSTEPSEGSAPGTSPSGES<br>STAPGTSPSGESSTAPGTSPSGESST<br>APGTSTEPSEGSAPGSPAGSPTSTE<br>EGTSTEPSEGSAPGSSPSASTGTGP<br>GSSTPSGATGSPGSSTPSGATGSPG<br>SSTPSGATGSPGSSTPSGATGSPGA<br>SPGTSSTGSPGASASGAPSTGGTSP<br>SGESSTAPGSTSSTAESPGPGTSPSG<br>ESSTAPGTSESATPESGPGTSTEPSE<br>GSAPGTSTEPSEGSAPGSSPSASTG<br>TGPGSSTPSGATGSPGASPGTSSTG<br>SPGTSTPESGSASPGTSPSGESSTAP<br>GTSPSGESSTAPGTSESATPESGPGS<br>EPATSGSETPGTSTEPSEGSAPGSTS<br>ESPSGTAPGSTSESPSGTAPGTSTPE<br>SGSASPGSPAGSPTSTEEGTSESATP<br>ESGPGTSTEPSEGSAPGSPAGSPTST<br>EEGTSESATPESGPGSEPATSGSETP<br>GSSTPSGATGSPGASPGTSSTGSPG<br>SSTPSGATGSPGSTSESPSGTAPGTS<br>PSGESSTAPGSTSSTAESPGPGSSTP<br>SGATGSPGASPGTSSTGSPGTPGSG<br>TASSSPGSPAGSPTSTEEGSPAGSPT<br>STEEGTSTEPSEGSAP | | | | |
| AM923 | MAEPAGSPTSTEEGASPGTSSTGSP<br>GSSTPSGATGSPGSSTPSGATGSPG<br>TSTEPSEGSAPGSEPATSGSETPGSP<br>AGSPTSTEEGSTSSTAESPGPGTSTP<br>ESGSASPGSTSESPSGTAPGSTSESP<br>SGTAPGTSTPESGSASPGTSTPESGS<br>ASPGSEPATSGSETPGTSESATPES<br>GPGSPAGSPTSTEEGTSTEPSEGSA<br>PGTSESATPESGPGTSTEPSEGSAP<br>GTSTEPSEGSAPGSPAGSPTSTEEG<br>TSTEPSEGSAPGSTSTEPSEGSAPGTS<br>ESATPESGPGTSESATPESGPGTSTE<br>PSEGSAPGTSTEPSEGSAPGTSESA<br>TPESGPGTSTEPSEGSAPGSEPATS<br>GSETPGSPAGSPTSTEEGSSTPSGA<br>TGSPGTPGSGTASSSPGSSTPSGAT<br>GSPGTSTEPSEGSAPGTSTEPSEGS<br>APGSEPATSGSETPGSPAGSPTSTE<br>EGSPAGSPTSTEEGTSTEPSEGSAP<br>GASASGAPSTGGTSESATPESGPGS<br>PAGSPTSTEEGSPAGSPTSTEEGSTS<br>STAESPGPGSTSESPSGTAPGTSPSG<br>ESSTAPGTPGSGTASSSPGSSTPSG<br>ATGSPGSSPSASTGTGPGSEPATSG<br>SETPGTSESATPESGPGSEPATSGSE<br>TPGSTSSTAESPGPGSTSSTAESPGP<br>GTSPSGESSTAPGSEPATSGSETPGS<br>EPATSGSETPGTSTEPSEGSAPGSTS<br>STAESPGPGTSTPESGSASPGSTSES<br>PSGTAPGTSTEPSEGSAPGTSTEPSE<br>GSAPGTSTEPSEGSAPGSSTPSGAT<br>GSPGSSPSASTGTGPGASPGTSSTG<br>SPGSEPATSGSETPGTSESATPESGP<br>GSPAGSPTSTEEGSSTPSGATGSPG<br>SSPSASTGTGPGASPGTSSTGSPGT<br>SESATPESGPGTSTEPSEGSAPGTST<br>EPSEGSAP | 645 | 924 | Residue totals: H: 4 E: 3<br>percent: H: 0.4 E: 0.3 | 98.70% |
| AE912 | MAEPAGSPTSTEEGTPGSGTASSSP<br>GSSTPSGATGSPGASPGTSSTGSPG<br>SPAGSPTSTEEGTSESATPESGPGTS<br>TEPSEGSAPGSPAGSPTSTEEGTSTE<br>PSEGSAPGTSTEPSEGSAPGTSESA<br>TPESGPGSEPATSGSETPGSEPATS<br>GSETPGSPAGSPTSTEEGTSESATPE<br>SGPGTSTEPSEGSAPGTSTEPSEGS<br>APGSPAGSPTSTEEGTSTEPSEGSA | 646 | 913 | Residue totals: H: 8 E: 3<br>percent: H: 0.9 E: 0.3 | 99.45% |

TABLE 27-continued

CHOU-FASMAN and GOR prediction calculations of polypeptide sequences

| SEQ NAME | Sequence | SEQ ID NO: | No. Residues | Chou-Fasman Calculation | GOR Calculation |
|---|---|---|---|---|---|
| | PGTSTEPSEGSAPGTSESATPESGP GTSTEPSEGSAPGTSESATPESGPG SEPATSGSETPGTSTEPSEGSAPGTS TEPSEGSAPGTSESATPESGPGTSES ATPESGPGSPAGSPTSTEEGTSESA TPESGPGSEPATSGSETPGTSESATP ESGPGTSTEPSEGSAPGTSTEPSEGS APGTSTEPSEGSAPGTSTEPSEGSA PGTSTEPSEGSAPGTSTEPSEGSAP GSPAGSPTSTEEGTSTEPSEGSAPG TSESATPESGPGSEPATSGSETPGTS ESATPESGPGSEPATSGSETPGTSES ATPESGPGTSTEPSEGSAPGTSESA TPESGPGSPAGSPTSTEEGSPAGSPT STEEGSPAGSPTSTEEGTSESATPES GPGTSTEPSEGSAPGTSESATPESG PGSEPATSGSETPGTSESATPESGP GSEPATSGSETPGTSESATPESGPG TSTEPSEGSAPGSPAGSPTSTEEGTS ESATPESGPGSEPATSGSETPGTSES ATPESGPGSPAGSPTSTEEGSPAGS PTSTEEGTSTEPSEGSAPGTSESATP ESGPGTSESATPESGPGTSESATPES GPGSEPATSGSETPGSEPATSGSET PGSPAGSPTSTEEGTSTEPSEGSAP GTSTEPSEGSAPGSEPATSGSETPG TSESATPESGPGTSTEPSEGSAP | | | | |
| BC 864 | GTSTEPSEPGSAGTSTEPSEPGSAG SEPATSGTEPSGSGASEPTSTEPGSE PATSGTEPSGSEPATSGTEPSGSEP ATSGTEPSGSGASEPTSTEPGTSTEP SEPGSAGSEPATSGTEPSGTSTEPSE PGSAGSEPATSGTEPSGSEPATSGT EPSGTSTEPSEPGSAGTSTEPSEPGS AGSEPATSGTEPSGSEPATSGTEPS GTSEPSTSEPGAGSGASEPTSTEPG TSEPSTSEPGAGSEPATSGTEPSGSE PATSGTEPSGTSTEPSEPGSAGTSTE PSEPGSAGSGASEPTSTEPGSEPATS GTEPSGSEPATSGTEPSGSEPATSG TEPSGSEPATSGTEPSGTSTEPSEPG SAGSEPATSGTEPSGSGASEPTSTE PGTSTEPSEPGSAGSEPATSGTEPS GSGASEPTSTEPGTSTEPSEPGSAG SGASEPTSTEPGSEPATSGTEPSGS GASEPTSTEPGSEPATSGTEPSGSG ASEPTSTEPGTSTEPSEPGSAGSEPA TSGTEPSGSGASEPTSTEPGTSTEPS EPGSAGSEPATSGTEPSGTSTEPSEP GSAGSEPATSGTEPSGTSTEPSEPG SAGTSTEPSEPGSAGTSTEPSEPGS AGTSTEPSEPGSAGTSTEPSEPGSA GTSTEPSEPGSAGTSEPSTSEPGAG SGASEPTSTEPGTSTEPSEPGSAGTS TEPSEPGSAGTSTEPSEPGSAGSEP ATSGTEPSGSGASEPTSTEPGSEPA TSGTEPSGSEPATSGTEPSGSEPATS GTEPSGSEPATSGTEPSGTSEPSTSE PGAGSEPATSGTEPSGSGASEPTST EPGTSTEPSEPGSAGSEPATSGTEPS GSGASEPTSTEPGTSTEPSEPGSA | 647 | | Residue totals: H: 0 E: 0 percent: H: 0 E: 0 | 99.77% |
| | ASPAAPAPASPAAPAPSAPAAAPA SPAPAAPSAPAPAAPSAASPAAPSA PPAAASPAAPSAPPAASAAAPAAA SAAASAPSAAA | 648 | 84 | Residue totals: H: 58 E: 0 percent: H: 69.0 E: 0.0 | 78.57% |

*H: alpha-helix E: beta-sheet

Example 44: Analysis of Polypeptide Sequences for Repetitiveness

Polypeptide amino acid sequences can be assessed for repetitiveness by quantifying the number of times a shorter subsequence appears within the overall polypeptide. For example, a polypeptide of 200 amino acid residues has 192 overlapping 9-amino acid subsequences (or 9-mer "frames"), but the number of unique 9-mer subsequences will depend on the amount of repetitiveness within the sequence. In the present analysis, different sequences were assessed for repetitiveness by summing the occurrence of all unique 3-mer subsequences for each 3-amino acid frame across the first 200 amino acids of the polymer portion divided by the absolute number of unique 3-mer subsequences within the 200 amino acid sequence. The resulting subsequence score is a reflection of the degree of repetitiveness within the polypeptide.

The results, shown in Table 28, indicate that the unstructured polypeptides consisting of 2 or 3 amino acid types have high subsequence scores, while those of consisting of 12 amino acids motifs of the six amino acids G, S, T, E, P, and A with a low degree of internal repetitiveness, have subsequence scores of less than 10, and in some cases, less than 5. For example, the L288 sequence has two amino acid types and has short, highly repetitive sequences, resulting in a subsequence score of 50.0. The polypeptide J288 has three amino acid types but also has short, repetitive sequences, resulting in a subsequence score of 33.3. Y576 also has three amino acid types, but is not made of internal repeats, reflected in the subsequence score of 15.7 over the first 200 amino acids. W576 consists of four types of amino acids, but has a higher degree of internal repetitiveness, e.g., "GGSG" (SEQ ID NO: 649), resulting in a subsequence score of 23.4. The AD576 consists of four types of 12 amino acid motifs, each consisting of four types of amino acids. Because of the low degree of internal repetitiveness of the individual motifs, the overall subsequence score over the first 200 amino acids is 13.6. In contrast, XTEN's consisting of four motifs contains six types of amino acids, each with a low degree of internal repetitiveness have lower subsequence scores; i.e., AE864 (6.1), AF864 (7.5), and AM875 (4.5).

Conclusions:

The results indicate that the combination of 12 amino acid subsequence motifs, each consisting of four to six amino acid types that are essentially non-repetitive, into a longer XTEN polypeptide results in an overall sequence that is non-repetitive. This is despite the fact that each subsequence motif may be used multiple times across the sequence. In contrast, polymers created from smaller numbers of amino acid types resulted in higher subsequence scores, although the actual sequence can be tailored to reduce the degree of repetitiveness to result in lower subsequence scores.

TABLE 28

Subsequence score calculations of polypeptide sequences

| Seq Name | Amino Acid Sequence | SEQ ID NO: | Score |
|---|---|---|---|
| J288 | GSGGEGGSGGEGGSGGEGGSGGEGGSGGEGGSGGEGGSGGEGGSGGEGGSGGE GGSGGEGGSGGEGGSGGEGGSGGEGGSGGEGGSGGEGGSGGEGGSGGEGGSG GEGGSGGEGGSGGEGGSGGEGGSGGEGGSGGEGGSGGEGGSGGEGGSGGEGGS GGEGGSGGEGGSGGEGGSGGEGGSGGEGGSGGEGGSGGEGGSGGEGGSGGEG GSGGEGGSGGEGGSGGEGGSGGEGGSGGEGGSGGEGGSGGEGGSGGEGGSGGE GGSGGEGGSGGEGGSGGEGGSGGEG | 650 | 33.3 |
| K288 | GEGEGGGEGGEGEGGGEGGEGEGGGEGGEGEGGGEGGEGEGGGEGGEGEGGG EGGEGEGGGEGGEGEGGGEGGEGEGGGEGGEGEGGGEGGEGEGGGEGGEGEG GGEGGEGEGGGEGGEGEGGGEGGEGEGGGEGGEGEGGGEGGEGEGGGEGGEG EGGGEGGEGEGGGEGGEGEGGGEGGEGEGGGEGGEGEGGGEGGEGEGGGEGG EGEGGGEGGEGEGGGEGGEGEGGGEGGEGEGGGEGGEGEGGGEGGEGEGGGE GGEGEGGGEGGEGEGGGEGGEGEGGGEG | 651 | 46.9 |
| L288 | SSESSSESSSSESSSESSSESSSSESSSESSSESSSSESSSESSSESSSSESSSESSSESSSSESSS ESSESSSSESSSESSSESSSSESSSESSSESSSSESSSESSSESSSSESSSESSSESSSSESSSES SESSSSESSSESSSESSSSESSSESSSESSSSESSSESSSESSSSESSSESSSESSSSESSSESSE SSSSESSSESSSESSSSESSSESSSESSSSESSSESSSESSSSESSSESSSESSSSESSSESSSESS SSESSSESSSESSSSESSSESSSESSSSESSSESSSESSSSES | 652 | 50.0 |
| Y288 | GEGSGEGSEGEGSEGSGEGEGSEGSEGEGGSEGSEGEGGSEGSEGEGGSEGSEG EGSGEGSEGEGGSEGSEGEGSGEGSEGEGSEGGSEGEGGSEGSEGEGSGEGSEGE GGEGGSEGEGSEGSGEGSGEGSEGEGSEGSGEGEGGSEGSEGEGSEGSGEGE GSEGSGEGGSEGSGEGEGSEGSGEGEGGSEGSGEGSEGGSEGSEGEGGGEGSEGE GSGEGGEGEGSEGGSEGEGGSEGGSEGGSGEGSGEGSEGGSEGSEGGSEGE GSEGSGEGEGSEGSGE | 653 | 26.8 |
| Q576 | GGKPGEGGKPEGGGGKPGGKPEGEGEGKPGGKPEGGGKPGGGEGGKPEGGKPE GEGKPGGGEGKPGGKPEGGGGKPEGEGKPGGGGGKPGGKPEGEGKPGGGEGG KPEGKPGEGGEGKPGGKPEGGGEGKPGGGKPGEGGKPGEGKPGGGEGGKPEGG KPEGEGKPGGGEGKPGGKPGEGGKPEGGGEGKPGGKPGEGGEGKPGGGKPEGE GKPGGGKPGGGEGGKPEGEGKPGGKPEGGGGEGKPGGKPEGGGKPEGGGGEGKP GGGKPGEGGKPGEGEGKPGGKPEGEGKPGGEGGGKPEGKPGGGEGGGKPEGGKP GEGGKPEGGKPGEGGEGKPGGGKPGEGGKPEGGGKPEGEGKPGGGGKPGEGG KPEGGKPEGGGEGKPGGGKPEGEGKPGGGEGKPGGKPEGGGGKPGEGGKPEGG KPGGEGGGKPEGEGKPGGKPGEGGKPEGGKPEGEGKPGEGGEGKPGGKPEGG GEGKPGGKPEGGGEGKPGGGKPGEGGKPEGGGKPGEGGKPGEGGKPEGEGKPG GGEGKPGGKPGEGGKPEGGGEGKPGGKPGEGGGKPEGGKPGEGGKPEG | 654 | 18.5 |
| U576 | GEGKPGGKPGSGGGKPGEGGKPGSGEGKPGGKPGSGGSGKPGGKPGEGGKPEG GSGGKPGGGGKPGGKPGGEGSGKPGGKPEGGGKPEGGSGGKPGGKPEGGSGG | 655 | 18.1 |

TABLE 28-continued

Subsequence score calculations of polypeptide sequences

| Seq Name | Amino Acid Sequence | SEQ ID NO: | Score |
|---|---|---|---|
| | KPGGKPGSGEGGKPGGGKPGGGKPGGEGKPGSGKPGGEGSGKPGGKPEGGSGGKPGGK<br>PEGGSGGKPGGSGKPGGKPGEGGKPEGGSGGKPGGSGKPGGKPEGGGSGKPGG<br>KPGEGGKPGSGEGGKPGGGKPGGEGKPGSGKPGGEGSGKPGSGGEGKPG<br>GKPEGGSGGKPGGGKPGGEGKPGSGKPGEGGKPGSGGGKPGGKPGGEGEGKP<br>GGKPGEGGKPGGEGSGKPGGGGKPGGKPGGEGGKPEGSGKPGGGSGKPGGKPE<br>GGGGKPEGSGKPGGGKPEGSGKPGGGKPEGGSGGKPGGSGKPGGKPGEGGG<br>KPEGSGKPGGGSGKPGGKPEGGGKPEGGSGGKPGGKPEGGSGGKPGGKPGGEG<br>SGKPGGKPGSGEGGKPGGKPGEGSGGKPGGKPEGGSGGKPGGSGKPGGKPEGG<br>GSGKPGGKPGEGGKPGGEGSGKPGGSGKPG | | |
| W576 | GGSGKPGKPGGSGSGKPGSGKPGGGSGKPGSGKPGGGSGKPGSGKPGGGSGKP<br>GSGKPGGGGKPGSGSGKPGGGKPGGSGKPGGGSGKPGKPGSGGSGKPGSGKP<br>GGGSGGKPGKPGSGGSGKPGKPGSGGGSGKPGKPGSGGSGGKPGKPGSGGSG<br>GKPGKPGSGGSGKPGSGKPGGGSGKPGSGKPGSGGSGKPGKPGSGGSGKPGSG<br>KPGSGSGKPGSGKPGGGSGKPGSGKPGSGGSGKPGKPGSGGGKPGSGSGKPGG<br>GKPGSGSGKPGGGKPGGSGKPGGSGGKPGKPGSGGGSGKPGKPGSGGGSGKP<br>GKPGGSGSGKPGSGKPGGGSGKPGSGKPGSGGSGKPGKPGSGGSGGKPGKPGS<br>GGGKPGSGSGKPGGGKPGSGSGKPGGGKPGSGSGKPGGGKPGSGSGKPGGSGK<br>PGSGKPGGGSGGKPGKPGSGGSGKPGSGKPGSGGSGKPGKPGGSGSGKPGSGKP<br>GGGSGKPGSGKPGGGSGKPGSGKPGGGSGKPGSGKPGGGGKPGSGSGKPGGSG<br>KPGKPGSGGSGGKPGKPGSGGSGKPGSGKPGGGSGGKPGKPGSGG | 656 | 23.4 |
| Y576 | GEGSGEGSEGEGSEGSGEGEGSEGSGEGEGGSEGSEGEGSEGSGEGGEGSGE<br>GEGSGEGSEGEGGGEGSEGEGSGEGEGGEGSEGSEGEGSEGGGEGSEGSGE<br>GEGSEGGSGEGEGSEGGSEGEGSEGSGEGEGSEGSGEGEGSEGSGEGSEGSGEG<br>EGSEGGSGEGGSEGSEGSGEGSEGEGGSEGSEGEGGGEGSEGEGSGEGSEGE<br>GGSEGSEGEGGSEGSEGEGGEGSGEGEGSEGSGEGEGSGEGSEGEGSEGSGEGE<br>GSEGSGEGEGSEGSEGEGSGEGSEGEGGSGEGSEGEGSEGSGEGEGSEGSEGEG<br>GSEGSEGEGGSEGSEGEGGGEGSGEGEGSEGSGEGEGSGEGSEGEGSGEGSEGEGS<br>EGSGEGEGGSEGSEGEGSEGSGEGEGGGEGSGEGEGSGEGSEGEGGEGSEGEGS<br>EGSGEGEGS EGSGEGEGSEGGSEGEGGSEGSEGEGSEGGSEGEGSEGGSEGEGSE<br>GSGEGEGSEGSGEGEGSGEGSEGEGGSEGGEGEGSEGGSEGEGSEGGSEGEGGE<br>GSGEGEGGGEGSEGEGSEGSGEGEGSGEGSE | 657 | 15.7 |
| AD576 | GSSESGSSEGGPGSSGGEPSESGSSGSSESGSSEGGPGSSESGSSEGGPGSSESGSSE<br>GGPGSSESGSSEGGPGSSESGSSEGGPGESPGGSSGSESGSEGSSGPGESSGGSSESG<br>SSEGGPGSSESGSSEGGPGSSESGSSEGGPGSSGGEPSESGSSGESPGGSSGSESGES<br>PGGSSGSESGSGGEPSESGSSGSSESGSSEGGPGSGGEPSESGSSGSGGEPSESGSS<br>GSEGSSGPGESSGESPGGSSGSESGSGGEPSESGSSGSGGEPSESGSSGSGGEPSES<br>GSSGSSESGSSEGGPGESPGGSSGSESGESPGGSSGSESGESPGGSSGSESGESPGG<br>SSGSESGSPGGSSGSESGSSESGSSEGGPGSSGGEPSESGSSGSGSSGPGESSGSSE<br>SGSSEGGPGSGGEPSESGSSGSSESGSSEGGPGSSGGEPSESGSSGESPGGSSGSESG<br>ESPGGSSGSESGSSESGSSEGGPGSGGEPSESGSSGSSESGSSEGGPGSGGEPSESG<br>SSGSGGEPSESGSSGESPGGSSGSESGSEGSSGPGESSGSSESGSSEGGPGSEGSSG<br>PGESS | 658 | 13.6 |
| AE576 | AGSPAGSPTSTEEGTSESATPESGPGTSTEPSEGSAPGSPAGSPTSTEEGTSTEPSE<br>GSAPGTSTEPSEGSAPGTSESATPESGPGSEPATSGSETPGSEPATSGSETPGSPAG<br>SPTSTEEGTSESATPESGPGTSTEPSEGSAPGTSTEPSEGSAPGSPAGSPTSTEEGTS<br>TEPSEGSAPGTSTEPSEGSAPGTSESATPESGPGTSTEPSEGSAPGTSESATPESGPG<br>SEPATSGSETPGTSTEPSEGSAPGTSTEPSEGSAPGTSESATPESGPGTSESATPESG<br>PGSPAGSPTSTEEGTSESATPESGPGSEPATSGSETPGTSESATPESGPGTSTEPSEG<br>SAPGTSTEPSEGSAPGTSTEPSEGSAPGTSTEPSEGSAPGTSTEPSEGSAPGTSTEPS<br>EGSAPGSPAGSPTSTEEGTSTEPSEGSAPGTSESATPESGPGSEPATSGSETPGTSES<br>ATPESGPGSEPATSGSETPGTSESATPESGPGTSTEPSEGSAPGTSESATPESGPGSP<br>AGSPTSTEEGSPAGSPTSTEEGSPAGSPTSTEEGTSESATPESGPGTSTEPSEGSAP | 659 | 6.1 |
| AF540 | GSTSSTAESPGPGSTSSTAESPGPGSTSESPSGTAPGSTSSTAESPGPGSTSSTAESP<br>GPGTSTPESGSASPGSTSESPSGTAPGTSPSGESSTAPGSTSESPSGTAPGSTSESPS<br>GTAPGTSPSGESSTAPGSTSESPSGTAPGSTSESPSGTAPGTSPSGESSTAPGSTSES<br>PSGTAPGSTSESPSGTAPGSTSESPSGTAPGTSTPESGSASPGSTSESPSGTAPGTST<br>PESGSASPGSTSSTAESPGPGSTSSTAESPGPGTSTPESGSASPGSTSTPESGSASPGS<br>TSESPSGTAPGTSTPESGSASPGTSTPESGSASPGSTSESPSGTAPGSTSESPSGTAP<br>GSTSESPSGTAPGSTSSTAESPGPGSTSTPESGSASPGTSTPESGSASPGSTSESPSGT<br>APGSTSESPSGTAPGSTSTPESGSASPGSTSESPSGTAPGSTSESPSGTAPGSTSPESG<br>SASPGSTSPSGESSTAPGSTSSTAESPGPGTSPSGESSTAPGSTSSTAESPGPGTSTPE<br>SGSASPGSTSESPSGTAP | 660 | 8.8 |
| AF504 | GASPGTSSTGSPGSSPSASTGTGPGSSPSASTGTGPGTPGSGTASSSPGSSTPSGAT<br>GSPGSNPSASTGTGPGASPGTSSTGSPGTPGSGTASSSPGSSTPSGATGSPGTPGSG<br>TASSSPGASPGTSSTGSPGTPGSGTASSSPGSSTPSGATGSPGSNPSASTGTGPGASS<br>PGTSSTGSPGTPGSGTASSSPGSSTPSGATGSPGSNPSASTGTGPGSSPSASTGTGP<br>GSSTPSGATGSPGSSTPSGATGSPGASPGTSSTGSPGASPGTSSTGSPGASPGTSST<br>GSPGTPGSGTASSSPGASPGTSSTGSPGASPGTSSTGSPGASPGTSSTGSPGSSPSA<br>STGTGPGTPGSGTASSSPGASPGTSSTGSPGASPGTSSTGSPGASPGTSSTGSPGSS | 661 | 7.0 |

TABLE 28-continued

Subsequence score calculations of polypeptide sequences

| Seq Name | Amino Acid Sequence | SEQ ID NO: | Score |
|---|---|---|---|
| | TPSGATGSPGSSTPSGATGSPGASPGTSSTGSPGTPGSGTASSSPGSSTPSGATGSP GSSTPSGATGSPGSSTPSGATGSPGSSPSASTGTGPGASPGTSSTGSP | | |
| AE864 | GSPAGSPTSTEEGTSESATPESGPGTSTEPSEGSAPGSPAGSPTSTEEGTSTEPSEGS APGTSTEPSEGSAPGTSESATPESGPGSEPATSGSETPGSEPATSGSETPGSPAGSP TSTEEGTSESATPESGPGTSTEPSEGSAPGTSTEPSEGSAPGSPAGSPTSTEEGTSTE PSEGSAPGTSTEPSEGSAPGTSESATPESGPGTSTEPSEGSAPGTSESATPESGPGSE PATSGSETPGTSTEPSEGSAPGTSTEPSEGSAPGTSESATPESGPGTSESATPESGPG SPAGSPTSTEEGTSESATPESGPGSEPATSGSETPGTSESATPESGPGTSTEPSEGSA PGTSTEPSEGSAPGTSTEPSEGSAPGTSTEPSEGSAPGTSTEPSEGSAPGTSTEPSEG SAPGSPAGSPTSTEEGTSTEPSEGSAPGTSESATPESGPGSEPATSGSETPGTSESAT PESGPGSEPATSGSETPGTSESATPESGPGTSTEPSEGSAPGTSESATPESGPGSPA GSPTSTEEGSPAGSPTSTEEGSPAGSPTSTEEGTSESATPESGPGTSTEPSEGSAPGT SESATPESGPGSEPATSGSETPGTSESATPESGPGSEPATSGSETPGTSESATPESGP GTSTEPSEGSAPGSPAGSPTSTEEGTSESATPESGPGSEPATSGSETPGTSESATPES GPGSPAGSPTSTEEGSPAGSPTSTEEGTSTEPSEGSAPGTSESATPESGPGTSESATP ESGPGTSESATPESGPGSEPATSGSETPGSEPATSGSETPGSPAGSPTSTEEGTSTEP SEGSAP | 662 | 6.1 |
| AF864 | GSTSESPSGTAPGTSPSGESSTAPGSTSESPSGTAPGSTSESPSGTAPGTSTPESGSA SPGTSTPESGSASPGSTSESPSGTAPGSTSESPSGTAPGTSPSGESSTAPGSTSESPS GTAPGTSPSGESSTAPGTSPSGESSTAPGSTSSTAESPGPGTSPSGESSTAPGTSPSG ESSTAPGSTSSTAESPGPGTSTPESGSASPGTSTPESGSASPGSTSESPSGTAPGSTS ESPSGTAPGTSTPESGSASPGSTSSTAESPGPGTSTPESGSASPGSTSESPSGTAPGT SPSGESSTAPGSTSSTAESPGPGTSPSGESSTAPGTSTPESGSASPGSTSSTAESPGP GSTSSTAESPGPGSTSSTAESPGPGSTSSTAESPGPGTSPSGESSTAPGSTSESPSGT APGSTSESPSGTAPGTSTPESGPXXXGASASGAPSTXXXXSESPSGTAPGSTSESPS GTAPGSTSESPSGTAPGSTSESPSGTAPGSTSESPSGTAPGTSESPSGTAPGTSTPE SGSASPGTSPSGESSTAPGTSPSGESSTAPGSTSSTAESPGPGTSPSGESSTAPGTST PESGSASPGSTSESPSGTAPGSTSESPSGTAPGTSPSGESSTAPGSTSESPSGTAPGT STPESGSASPGTSTPESGSASPGSTSESPSGTAPGTSTPESGSASPGSTSSTAESPGP GSTSESPSGTAPGSTSESPSGTAPGTSPSGESSTAPGSTSSTAESPGPGTSPSGESST APGTSTPESGSASPGTSPSGESSTAPGTSPSGESSTAPGTSPSGESSTAPGSTSSTAE SPGPGSTSSTAESPGPGTSPSGESSTAPGSSPSASTGTGPGSSTPSGATGSPGSSTPS GATGSP | 663 | 7.5 |
| AG868 | GGSPGASPGTSSTGSPGSSPSASTGTGPGSSPSASTGTGPGTPGSGTASSSPGSSTP SGATGSPGSNPSASTGTGPGASPGTSSTGSPGTPGSGTASSSPGSSTPSGATGSPGT PGSGTASSSPGASPGTSSTGSPGASPGTSSTGSPGTPGSGTASSSPGSSTPSGATGS PGASPGTSSTGSPGTPGSGTASSSPGSSTPSGATGSPGSNPSASTGTGPGSSPSAST GTGPGSSTPSGATGSPGSSTPSGATGSPGASPGTSSTGSPGASPGTSSTGSPGASPG TSSTGSPGTPGSGTASSSPGASPGTSSTGSPGASPGTSSTGSPGASPGTSSTGSPGSS PSASTGTGPGTPGSGTASSSPGASPGTSSTGSPGASPGTSSTGSPGASPGTSSTGSP GSSTPSGATGSPGSSTPSGATGSPGASPGTSSTGSPGTPGSGTASSSPGSSTPSGAT GSPGSSTPSGATGSPGSSTPSGATGSPGSSPSASTGTGPGASPGTSSTGSPGASPGT SSTGSPGTPGSGTASSSPGASPGTSSTGSPGASPGTSSTGSPGASPGTSSTGSPGAS PGTSSTGSPGTPGSGTASSSPGSSTPSGATGSPGTPGSGTASSSPGSSTPSGATGSP GTPGSGTASSSPGSSTPSGATGSPGSSTPSGATGSPGSSPSASTGTGPGSSPSASTG TGPGASPGTSSTGSPGTPGSGTASSSPGSSTPSGATGSPGSSPSASTGTGPGSSPSA STGTGPGASPGTSSTGSPGASPGTSSTGSPGSSTPSGATGSPGSSPSASTGTGPGAS PGTSSTGSPGSSPSASTGTGPGTPGSGTASSSPGSSTPSGATGSPGSSTPSGATGSP GASPGTSSTGSP | 664 | 7.5 |
| AM875 | GTSTEPSEGSAPGSEPATSGSETPGSPAGSPTSTEEGTSSTAESPGPGTSTPESGSA SPGSTSESPSGTAPGSTSESPSGTAPGTSTPESGSASPGTSTPESGSASPGSEPATSG SETPGTSESATPESGPGSPAGSPTSTEEGTSTEPSEGSAPGTSESATPESGPGTSTEP SEGSAPGTSTEPSEGSAPGSPAGSPTSTEEGTSTEPSEGSAPGTSTEPSEGSAPGTSE SATPESGPGTSESATPESGPGTSTEPSEGSAPGTSTEPSEGSAPGTSESATPESGPGT STEPSEGSAPGSEPATSGSETPGSPAGSPTSTEEGSSTPSGATGSPGTPGSGTASSSP GSSTPSGATGSPGTSTEPSEGSAPGTSTEPSEGSAPGSEPATSGSETPGSPAGSPTST EEGSPAGSPTSTEEGTSTEPSEGSAPGASASGAPSTGGTSESATPESGPGSPAGSPT STEEGSPAGSPTSTEEGTSSTAESPGPGTSESPSGTAPGTSPSGESSTAPGTPGSG TASSSPGSSTPSGATGSPGSSPSASTGTGPGSEPATSGSETPGTSESATPESGPGSEP ATSGSETPGTSSTAESPGPGTSSTAESPGPGTSPSGESSTAPGSEPATSGSETPGS EPATSGSETPGTSTEPSEGSAPGSTSSTAESPGPGTSTPESGSASPGSTSESPSGTAP GTSTEPSEGSAPGTSTEPSEGSAPGTSTEPSEGSAPGSSTPSGATGSPGSSPSASTGT GPGASPGTSSTGSPGSEPATSGSETPGTSESATPESGPGSPAGSPTSTEEGSSTPSG ATGSPGSSPSASTGTGPGASPGTSSTGSPGTSESATPESGPGTSTEPSEGSAPGTST EPSEGSAP | 665 | 4.5 |
| AM1318 | GTSTEPSEGSAPGSEPATSGSETPGSPAGSPTSTEEGTSSTAESPGPGTSTPESGSA SPGSTSESPSGTAPGSTSESPSGTAPGTSTPESGSASPGTSTPESGSASPGSEPATSG SETPGTSESATPESGPGSPAGSPTSTEEGTSTEPSEGSAPGTSESATPESGPGTSTEP SEGSAPGTSTEPSEGSAPGSPAGSPTSTEEGTSTEPSEGSAPGTSTEPSEGSAPGTSE SATPESGPGTSESATPESGPGTSTEPSEGSAPGTSTEPSEGSAPGTSESATPESGPGT | 666 | 4.5 |

TABLE 28-continued

Subsequence score calculations of polypeptide sequences

| Seq Name | Amino Acid Sequence | SEQ ID NO: | Score |
|---|---|---|---|
| | STEPSEGSAPGSEPATSGSETPGSPAGSPTSTEEGSSTPSGATGSPGTPGSGTASSSP | | |
| | GSSTPSGATGSPGTSTEPSEGSAPGTSTEPSEGSAPGSEPATSGSETPGSPAGSPTST | | |
| | EEGSPAGSPTSTEEGTSTEPSEGSAPGPEPTGPAPSGGSEPATSGSETPGTSESATP | | |
| | ESGPGSPAGSPTSTEEGTSESATPESGPGSPAGSPTSTEEGSPAGSPTSTEEGTSESA | | |
| | TPESGPGSPAGSPTSTEEGSPAGSPTSTEEGSTSSTAESPGPGSTSESPSGTAPGTSP | | |
| | SGESSTAPGSTSESPSGTAPGSTSESPSGTAPGTSPSGESSTAPGTSTEPSEGSAPGT | | |
| | SESATPESGPGTSESATPESGPGSEPATSGSETPGTSESATPESGPGTSESATPESGP | | |
| | GTSTEPSEGSAPGTSESATPESGPGTSTEPSEGSAPGTSPSGESSTAPGTSPSGESST | | |
| | APGTSPSGESSTAPGTSTEPSEGSAPGSPAGSPTSTEEGTSTEPSEGSAPGSSPSAST | | |
| | GTGPGSSTPSGATGSPGSSTPSGATGSPGSSTPSGATGSPGSSTPSGATGSPGASPG | | |
| | TSSTGSPGASASGAPSTGGTSPSGESSTAPGSTSSTAESPGPGTSPSGESSTAPGTS | | |
| | ESATPESGPGTSTEPSEGSAPGTSTEPSEGSAPGSSPSASTGTGPGSSTPSGATGSP | | |
| | GASPGTSSTGSPGTSTPESGSASPGTSPSGESSTAPGTSPSGESSTAPGTSESATPES | | |
| | GPGSEPATSGSETPGTSTEPSEGSAPGSTSESPSGTAPGSTSESPSGTAPGTSTPESG | | |
| | SASPGSPAGSPTSTEEGTSESATPESGPGTSTEPSEGSAPGSPAGSPTSTEEGTSESA | | |
| | TPESGPGSEPATSGSETPGSSTPSGATGSPGASPGTSSTGSPGSSTPSGATGSPGSTS | | |
| | ESPSGTAPGTSPSGESSTAPGSTSSTAESPGPGSSTPSGATGSPGASPGTSSTGSPGT | | |
| | PGSGTASSSPGSPAGSPTSTEEGSPAGSPTSTEEGTSTEPSEGSAP | | |

Example 45: Calculation of TEPITOPE Scores

TEPITOPE scores of 9mer peptide sequence can be calculated by adding pocket potentials as described by Sturniolo [Sturniolo, T., et al. (1999) Nat Biotechnol, 17: 555]. In the present Example, separate Tepitope scores were calculated for individual HLA alleles. Table 29 shows as an example the pocket potentials for HLA*0101B, which occurs in high frequency in the Caucasian population. To calculate the TEPITOPE score of a peptide with sequence P1-P2-P3-P4-P5-P6-P7-P8-P9, the corresponding individual pocket potentials in Table 29 were added. The HLA*0101B score of a 9mer peptide with the sequence FDKLPRTSG (SEQ ID NO: 667) would be the sum of 0, −1.3, 0, 0.9, 0, −1.8, 0.09, 0, 0.

To evaluate the TEPITOPE scores for long peptides one can repeat the process for all 9mer subsequences of the sequences. This process can be repeated for the proteins encoded by other HLA alleles. Tables 30-33 give pocket potentials for the protein products of HLA alleles that occur with high frequency in the Caucasian population.

TEPITOPE scores calculated by this method range from approximately −10 to +10. However, 9mer peptides that lack a hydrophobic amino acid (FKLMVWY (SEQ ID NO: 668)) in P1 position have calculated TEPITOPE scores in the range of −1009 to −989. This value is biologically meaningless and reflects the fact that a hydrophobic amino acid serves as an anchor residue for HLA binding and peptides lacking a hydrophobic residue in P1 are considered non binders to HLA. Because most XTEN sequences lack hydrophobic residues, all combinations of 9mer subsequences will have TEPITOPEs in the range in the range of −1009 to −989. This method confirms that XTEN polypeptides may have few or no predicted T-cell epitopes.

TABLE 29

Pocket potential for HLA*0101B allele.

| Amino Acid | P1 | P2 | P3 | P4 | P5 | P6 | P7 | P8 | P9 |
|---|---|---|---|---|---|---|---|---|---|
| A | −999 | 0 | 0 | 0 | — | 0 | 0 | — | 0 |
| C | −999 | 0 | 0 | 0 | — | 0 | 0 | — | 0 |
| D | −999 | −1.3 | −1.3 | −2.4 | — | −2.7 | −2 | — | −1.9 |
| E | −999 | 0.1 | −1.2 | −0.4 | — | −2.4 | −0.6 | — | −1.9 |

TABLE 29-continued

Pocket potential for HLA*0101B allele.

| Amino Acid | P1 | P2 | P3 | P4 | P5 | P6 | P7 | P8 | P9 |
|---|---|---|---|---|---|---|---|---|---|
| F | 0 | 0.8 | 0.8 | 0.08 | — | −2.1 | 0.3 | — | −0.4 |
| G | −999 | 0.5 | 0.2 | −0.7 | — | −0.3 | −1.1 | — | −0.8 |
| H | −999 | 0.8 | 0.2 | −0.7 | — | −2.2 | 0.1 | — | −1.1 |
| I | −1 | 1.1 | 1.5 | 0.5 | — | −1.9 | 0.6 | — | 0.7 |
| K | −999 | 1.1 | 0 | −2.1 | — | −2 | −0.2 | — | −1.7 |
| L | −1 | 1 | 1 | 0.9 | — | −2 | 0.3 | — | 0.5 |
| M | −1 | 1.1 | 1.4 | 0.8 | — | −1.8 | 0.09 | — | 0.08 |
| N | −999 | 0.8 | 0.5 | 0.04 | — | −1.1 | 0.1 | — | −1.2 |
| P | −999 | −0.5 | 0.3 | −1.9 | — | −0.2 | 0.07 | — | −1.1 |
| Q | −999 | 1.2 | 0 | 0.1 | — | −1.8 | 0.2 | — | −1.6 |
| R | −999 | 2.2 | 0.7 | −2.1 | — | −1.8 | 0.09 | — | −1 |
| S | −999 | −0.3 | 0.2 | −0.7 | — | −0.6 | −0.2 | — | −0.3 |
| T | −999 | 0 | 0 | −1 | — | −1.2 | 0.09 | — | −0.2 |
| V | −1 | 2.1 | 0.5 | −0.1 | — | −1.1 | 0.7 | — | 0.3 |
| W | 0 | −0.1 | 0 | −1.8 | — | −2.4 | −0.1 | — | −1.4 |
| Y | 0 | 0.9 | 0.8 | −1.1 | — | −2 | 0.5 | — | −0.9 |

TABLE 30

Pocket potential for HLA*0301B allele.

| Amino acid | P1 | P2 | P3 | P4 | P5 | P6 | P7 | P8 | P9 |
|---|---|---|---|---|---|---|---|---|---|
| A | −999 | 0 | 0 | 0 | — | 0 | 0 | — | 0 |
| C | −999 | 0 | 0 | 0 | — | 0 | 0 | — | 0 |
| D | −999 | −1.3 | −1.3 | 2.3 | — | −2.4 | −0.6 | — | −0.6 |
| E | −999 | 0.1 | −1.2 | −1 | — | −1.4 | −0.2 | — | −0.3 |
| F | −1 | 0.8 | 0.8 | −1 | — | −1.4 | 0.5 | — | 0.9 |
| G | −999 | 0.5 | 0.2 | 0.5 | — | −0.7 | 0.1 | — | 0.4 |
| H | −999 | 0.8 | 0.2 | 0 | — | −0.1 | −0.8 | — | −0.5 |
| I | 0 | 1.1 | 1.5 | 0.5 | — | 0.7 | 0.4 | — | 0.6 |
| K | −999 | 1.1 | 0 | −1 | — | 1.3 | −0.9 | — | −0.2 |
| L | 0 | 1 | 1 | 0 | — | 0.2 | 0.2 | — | 0 |
| M | 0 | 1.1 | 1.4 | 0 | — | −0.9 | 1.1 | — | 1.1 |
| N | −999 | 0.8 | 0.5 | 0.2 | — | −0.6 | −0.1 | — | −0.6 |
| P | −999 | −0.5 | 0.3 | −1 | — | 0.5 | 0.7 | — | −0.3 |
| Q | −999 | 1.2 | 0 | 0 | — | −0.3 | −0.1 | — | −0.2 |
| R | −999 | 2.2 | 0.7 | −1 | — | 1 | −0.9 | — | 0.5 |
| S | −999 | −0.3 | 0.2 | 0.7 | — | −0.1 | 0.07 | — | 1.1 |
| T | −999 | 0 | 0 | −1 | — | 0.8 | −0.1 | — | −0.5 |
| V | 0 | 2.1 | 0.5 | 0 | — | 1.2 | 0.2 | — | 0.3 |
| W | −1 | −0.1 | 0 | −1 | — | −1.4 | −0.6 | — | −1 |
| Y | −1 | 0.9 | 0.8 | −1 | — | −1.4 | −0.1 | — | 0.3 |

TABLE 31

Pocket potential for HLA*0401B allele.

| Amino acid | P1 | P2 | P3 | P4 | P5 | P6 | P7 | P8 | P9 |
|---|---|---|---|---|---|---|---|---|---|
| A | -999 | 0 | 0 | 0 | — | 0 | 0 | — | 0 |
| C | -999 | 0 | 0 | 0 | — | 0 | 0 | — | 0 |
| D | -999 | -1.3 | -1.3 | 1.4 | — | -1.1 | -0.3 | — | -1.7 |
| E | -999 | 0.1 | -1.2 | 1.5 | — | -2.4 | 0.2 | — | -1.7 |
| F | 0 | 0.8 | 0.8 | -0.9 | — | -1.1 | -1 | — | -1 |
| G | -999 | 0.5 | 0.2 | -1.6 | — | -1.5 | -1.3 | — | -1 |
| H | -999 | 0.8 | 0.2 | 1.1 | — | -1.4 | 0 | — | 0.08 |
| I | -1 | 1.1 | 1.5 | 0.8 | — | -0.1 | 0.08 | — | -0.3 |
| K | -999 | 1.1 | 0 | -1.7 | — | -2.4 | -1 | — | -0.3 |
| L | -1 | 1 | 1 | 0.8 | — | -1.1 | 0.7 | — | -1 |
| M | -1 | 1.1 | 1.4 | 0.9 | — | -1.1 | 0.8 | — | -0.4 |
| N | -999 | 0.8 | 0.5 | 0.9 | — | 1.3 | 0.6 | — | -1.4 |
| P | -999 | -0.5 | 0.3 | -1.6 | — | 0 | -0.7 | — | -1.3 |
| Q | -999 | 1.2 | 0 | 0.8 | — | -1.5 | 0 | — | 0.5 |
| R | -999 | 2.2 | 0.7 | -1.9 | — | -2.4 | -1.2 | — | -1 |
| S | -999 | -0.3 | 0.2 | 0.8 | — | 1 | -0.2 | — | 0.7 |
| T | -999 | 0 | 0 | 0.7 | — | 1.9 | -0.1 | — | -1.2 |
| V | -1 | 2.1 | 0.5 | -0.9 | — | 0.9 | 0.08 | — | -0.7 |
| W | 0 | -0.1 | 0 | -1.2 | — | -1 | -1.4 | — | -1 |
| Y | 0 | 0.9 | 0.8 | -1.6 | — | -1.5 | -1.2 | — | -1 |

TABLE 32

Pocket potential for HLA*0701B allele.

| Amino acid | P1 | P2 | P3 | P4 | P5 | P6 | P7 | P8 | P9 |
|---|---|---|---|---|---|---|---|---|---|
| A | -999 | 0 | 0 | 0 | — | 0 | 0 | — | 0 |
| C | -999 | 0 | 0 | 0 | — | 0 | 0 | — | 0 |
| D | -999 | -1.3 | -1.3 | -1.6 | — | -2.5 | -1.3 | — | -1.2 |
| E | -999 | 0.1 | -1.2 | -1.4 | — | -2.5 | 0.9 | — | -0.3 |
| F | 0 | 0.8 | 0.8 | 0.2 | — | -0.8 | 2.1 | — | 2.1 |
| G | -999 | 0.5 | 0.2 | -1.1 | — | -0.6 | 0 | — | -0.6 |
| H | -999 | 0.8 | 0.2 | 0.1 | — | -0.8 | 0.9 | — | -0.2 |
| I | -1 | 1.1 | 1.5 | 1.1 | — | -0.5 | 2.4 | — | 3.4 |
| K | -999 | 1.1 | 0 | -1.3 | — | -1.1 | 0.5 | — | -1.1 |
| L | -1 | 1 | 1 | -0.8 | — | -0.9 | 2.2 | — | 3.4 |
| M | -1 | 1.1 | 1.4 | -0.4 | — | -0.8 | 1.8 | — | 2 |

TABLE 32-continued

Pocket potential for HLA*0701B allele.

| Amino acid | P1 | P2 | P3 | P4 | P5 | P6 | P7 | P8 | P9 |
|---|---|---|---|---|---|---|---|---|---|
| N | -999 | 0.8 | 0.5 | -1.1 | — | -0.6 | 1.4 | — | -0.5 |
| P | -999 | -0.5 | 0.3 | -1.2 | — | -0.5 | -0.2 | — | -0.6 |
| Q | -999 | 1.2 | 0 | -1.5 | — | -1.1 | 1.1 | — | -0.9 |
| R | -999 | 2.2 | 0.7 | -1.1 | — | -1.1 | 0.7 | — | -0.8 |
| S | -999 | -0.3 | 0.2 | 1.5 | — | 0.6 | 0.4 | — | -0.3 |
| T | -999 | 0 | 0 | 1.4 | — | -0.1 | 0.9 | — | 0.4 |
| V | -1 | 2.1 | 0.5 | 0.9 | — | 0.1 | 1.6 | — | 2 |
| W | 0 | -0.1 | 0 | -1.1 | — | -0.9 | 1.4 | — | 0.8 |
| Y | 0 | 0.9 | 0.8 | -0.9 | — | -1 | 1.7 | — | 1.1 |

TABLE 33

Pocket potential for HLA*1501B allele.

| Amino acid | P1 | P2 | P3 | P4 | P5 | P6 | P7 | P8 | P9 |
|---|---|---|---|---|---|---|---|---|---|
| A | -999 | 0 | 0 | 0 | — | 0 | 0 | — | 0 |
| C | -999 | 0 | 0 | 0 | — | 0 | 0 | — | 0 |
| D | -999 | -1.3 | -1.3 | -0.4 | — | -0.4 | -0.7 | — | -1.9 |
| E | -999 | 0.1 | -1.2 | -0.6 | — | -1 | -0.7 | — | -1.9 |
| F | -1 | 0.8 | 0.8 | 2.4 | — | -0.3 | 1.4 | — | -0.4 |
| G | -999 | 0.5 | 0.2 | 0 | — | 0.5 | 0 | — | -0.8 |
| H | -999 | 0.8 | 0.2 | 1.1 | — | -0.5 | 0.6 | — | -1.1 |
| I | 0 | 1.1 | 1.5 | 0.6 | — | 0.05 | 1.5 | — | 0.7 |
| K | -999 | 1.1 | 0 | -0.7 | — | -0.3 | -0.3 | — | -1.7 |
| L | 0 | 1 | 1 | 0.5 | — | 0.2 | 1.9 | — | 0.5 |
| M | 0 | 1.1 | 1.4 | 1 | — | 0.1 | 1.7 | — | 0.08 |
| N | -999 | 0.8 | 0.5 | -0.2 | — | 0.7 | 0.7 | — | -1.2 |
| P | -999 | -0.5 | 0.3 | -0.3 | — | -0.2 | 0.3 | — | -1.1 |
| Q | -999 | 1.2 | 0 | -0.8 | — | -0.8 | -0.3 | — | -1.6 |
| R | -999 | 2.2 | 0.7 | 0.2 | — | 1 | -0.5 | — | -1 |
| S | -999 | -0.3 | 0.2 | -0.3 | — | 0.6 | 0.3 | — | -0.3 |
| T | -999 | 0 | 0 | -0.3 | — | -0 | 0.2 | — | -0.2 |
| V | 0 | 2.1 | 0.5 | 0.2 | — | -0.3 | 0.3 | — | 0.3 |
| W | -1 | -0.1 | 0 | 0.4 | — | -0.4 | 0.6 | — | -1.4 |
| Y | -1 | 0.9 | 0.8 | 2.5 | — | 0.4 | 0.7 | — | -0.9 |

TABLE 34

Exemplary Biological Activity, Exemplary Assays and Preferred Indications

| Biologically Active Protein | Biological Activity | Exemplary Activity Assay | Preferred Indication: |
|---|---|---|---|
| Insulin-like growth factor-1 (Mecasermin; Somazon; IGF-1; IGF-1 complex; CEP 151; CGP 35126; FK 780; Mecar; RHIGF-1; Somatomedin-1; Somatomedin-C; SOMATOKINE; MYOTROPHIN; IGEF; DepoIGF-1) | IGF-1 is a pleiotropic polypeptide with a wide range of actions in both central and peripheral nervous sytems. It is involved in growth and development and protects neurons against cell death via the activation of intracellular pathways implicating phosphatidylinositide 3/Akt kinase. | IGF-1 activity may be assayed in vitro using an serum withdrawal apoptosis-protection assay. (J Endocrinol 2000 October; 167(1): 165-74). Proliferation assay using breast carcinoma cell line MCF-7 (Karey 1988 Cancer Res. 48: 4083) | Diabetes mellitus; Growth disorders; Frailty; Amyotrophic lateral sclerosis; Osteoarthritis; Kidney disease & neuropathy; Dwarfism; HIV-1 infections; Myocardial ischaemia; Osteoporosis; Multiple sclerosis; Nerve disorders; Burns; diabetes; peripheral |
| Human growth hormone (Pegvisamont; Somatrem; Somatropin; TROVERT; PROTROPIN; BIO-TROPIN; | Binds to two GHR molecules and Induces signal transduction through receptor dimerization | 1) Ba/F3-hGHR proliferation assay, a novel specific bioassay for serum human growth hormone. J Clin Endocrinol Metab 2000 November; 85(11): | Acromegaly; Growth failure; Growth hormone replacement; Growth hormone deficiency; Pediatric Growth Hormone Deficiency; Adult Growth Hormone Deficiency; Idiopathic Growth Hormone |

TABLE 34-continued

Exemplary Biological Activity, Exemplary Assays and Preferred Indications

| Biologically Active Protein | Biological Activity | Exemplary Activity Assay | Preferred Indication: |
|---|---|---|---|
| HUMATROPE; NUTROPIN; NUTROPINAQ; NUTROPHIN; NORDITROPIN; GENOTROPIN; SAIZEN; SEROSTIM) | | 4274-9 Plasma growth hormone (GH) immunoassay and tibial bioassay, Appl Physiol (2000) 89(6): 2174-8. Growth hormone (hGH) receptor mediated cell mediated proliferation, Growth Horm IGF Res 2000 October; 10(5): 248-55 International standard for growth hormone, Horm Res 1999; 51 Suppl 1: 7-12 2) Detection of human growth hormone detected by direct radioimmunoassay performed on serial dilutions of lysed cell supernatants using the Phadebas HGH PRIST kit (Farmacia). U.S. Pat. No. 4,898,830 | Deficiency; Growth retardation; Prader-Willi Syndrome; Prader-Willi Syndrome in children 2 years or older; Growth deficiencies; Growth failure associated with chronic renal insufficiency; Osteoporosis; Postmenopausal osteoporosis; Osteopenia, Osteoclastogenesis; burns; Cachexia; Cancer Cachexia; Dwarfism; Metabolic Disorders; Obesity; Renal failure; Turner's Syndrome; Fibromyalgia; Fracture treatment; Frailty, AIDS wasting; Muscle Wasting; Short Stature; Diagnostic Agents; Female Infertility; lipodystrophy. |

TABLE 35

Exemplary GHXTEN comprising growth hormones and single XTEN

| GHXTEN Name* | Amino Acid Sequence | SEQ ID NO: | DNA Nucleotide Sequence | SEQ ID NO: |
|---|---|---|---|---|
| AE48-hGH | MAEPAGSPTSTEEGT PGSGTASSSPGSSTPS GATGSPGASPGTSST GSPGFPTIPLSRLFDN AMLRAHRLHQLAFD TYQEFEEAYIPKEQK YSFLQNPQTSLCFSE SIPTPSNREETQQKS NLELLRISLLLIQSWL EPVQFLRSVFANSLV YGASDSNVYDLLKD LEEGIQTLMGRLEDG SPRTGQIFKQTYSKF DTNSHNDDALLKNY GLLYCFRKDMDKVE TFLRIVQCRSVEGSC GF | 669 | ATGGCTGAACCTGCTGGCTCTCCAACCTCCACTGAGGAAGGTA CCCCGGGTAGCGTACTGCTTCTTCCTCTCCAGGTAGCTCTACC CCTTCTGGTGCAACCGGCTCTCCAGGTGCTTCTCCGGGCACCAG CTCTACCGGTTCTCCAGGTTTTCCGACTATTCCGCTGTCTCGTCT GTTTGATAATGCTATGCTGCGTGCGCACCGTCTGCACCAGCTGG CCTTTGATACTTACCAGGAATTTGAAGAAGCcTACATTCCTAAA GAGCAGAAGTACTCTTTCCTGCAAAACCCACAGACTTCTCTCTG CTTCAGCGAATCTATTCCGACGCCTTCCAATCGCGAGGAAACTC AGCAAAAGTCCAATCTGGAACTACTCCGCATTTCTCTGCTTCTG ATTCAGAGCTGGCTAGAACCAGTGCAATTTCTGCGTTCCGTCTT CGCCAATAGCCTAGTTTATGGCGCATCCGACAGCAACGTATAC GATCTCCTGAAAGATCTCGAGGAAGGCATTCAGACCCTGATGG GTCGTCTCGAGGATGGCTCTCCGCGTACTGGTCAGATCTTCAAG CAGACTTACTCTAAATTTGATACTAACAGCCACAATGACGATGC GCTTCTAAAAAACTATGGTCTGCTGTATTGTTTTCGTAAAGATA TGGACAAAGTTGAAACCTTCCTGCGTATTGTTCAGTGTCGTTCC GTTGAGGGCAGCTGTGGTTTCTAA | 670 |
| AM48-hGH | MAEPAGSPTSTEEGA SPGTSSTGSPGSSTPS GATGSPGSSTPSGAT GSPGFPTIPLSRLFDN AMLRAHRLHQLAFD TYQEFEEAYIPKEQK YSFLQNPQTSLCFSE SIPTPSNREETQQKS NLELLRISLLLIQSWL EPVQFLRSVFANSLV YGASDSNVYDLLKD LEEGIQTLMGRLEDG SPRTGQIFKQTYSKF DTNSHNDDALLKNY GLLYCFRKDMDKVE TFLRIVQCRSVEGSC GF | 671 | ATGGCTGAACCTGCTGGCTCTCCAACCTCCACTGAGGAAGGTG CATCCCCGGGCACCAGCTCTACCGGTTCTCCAGGTAGCTCTACC CCGTCTGGTGCTACCGGCTCTCCAGGTAGCTCTACCCCGTCTGG TGCTACTGGCTCTCCAGGTTTTCCGACTATTCCGCTGTCTCGTCT GTTTGATAATGCTATGCTGCGTGCGCACCGTCTGCACCAGCTGG CCTTTGATACTTACCAGGAATTTGAAGAAGCcTACATTCCTAAA GAGCAGAAGTACTCTTTCCTGCAAAACCCACAGACTTCTCTCTG CTTCAGCGAATCTATTCCGACGCCTTCCAATCGCGAGGAAACTC AGCAAAAGTCCAATCTGGAACTACTCCGCATTTCTCTGCTTCTG ATTCAGAGCTGGCTAGAACCAGTGCAATTTCTGCGTTCCGTCTT CGCCAATAGCCTAGTTTATGGCGCATCCGACAGCAACGTATAC GATCTCCTGAAAGATCTCGAGGAAGGCATTCAGACCCTGATGG GTCGTCTCGAGGATGGCTCTCCGCGTACTGGTCAGATCTTCAAG CAGACTTACTCTAAATTTGATACTAACAGCCACAATGACGATGC GCTTCTAAAAAACTATGGTCTGCTGTATTGTTTTCGTAAAGATA TGGACAAAGTTGAAACCTTCCTGCGTATTGTTCAGTGTCGTTCC GTTGAGGGCAGCTGTGGTTTCTAA | 672 |

TABLE 35-continued

Exemplary GHXTEN comprising growth hormones and single XTEN

| GHXTEN Name* | Amino Acid Sequence | SEQ ID NO: | DNA Nucleotide Sequence | SEQ ID NO: |
|---|---|---|---|---|
| AE144-hGH | GSEPATSGSETPGTS ESATPESGPGSEPAT SGSETPGSPAGSPTST EEGTSTEPSEGSAPG SEPATSGSETPGSEP ATSGSETPGSEPATS GSETPGTSTEPSEGS APGTSESATPESGPG SEPATSGSETPGTSTE PSEGSAPGFPTIPLSR LFDNAMLRAHRLHQ LAFDTYQEFEEAYIP KEQKYSFLQNPQTSL CFSESIPTPSNREETQ QKSNLELLRISLLLIQ SWLEPVQFLRSVFA NSLVYGASDSNVYD LLKDLEEGIQTLMGR LEDGSPRTGQIFKQT YSKFDTNSHNDDAL LKNYGLLYCFRKDM DKVETFLRIVQCRSV EGSCGF | 673 | GGTAGCGAACCGGCAACTTCCGGCTCTGAAACCCCAGGTACTT CTGAAAGCGCTACTCCTGAGTCTGGCCCAGGTAGCGAACCTGC TACCTCTGGCTCTGAAACCCCAGGTAGCCCGGCAGGCTCTCCGA CTTCCACCGAGGAAGGTACCTCTACTGAACCTTCTGAGGGTAGC GCTCCAGGTAGCGAACCGGCAACCTCTGGCTCTGAAACCCCAG GTAGCGAACCTGCTACCTCCGGCTCTGAAACTCCAGGTAGCGA ACCGGCTACTTCCGGTTCTGAAACTCCAGGTACCTCTACCGAAC CTTCCGAAGGCAGCGCACCAGGTACTTCTGAAAGCGCAACCCC TGAATCCGGTCCAGGTAGCGAACCGGCTACTTCTGGCTCTGAG ACTCCAGGTACTTCTACCGAACCGTCCGAAGGTAGCGCACCAG GTTTTCCGACTATTCCGCTGTCTCGTCTGTTTGATAATGCTATGC TGCGTGCGCACCGTCTGCACCAGCTGGCTTTTGATACTTACCAG GAATTTGAAGAAGCcTACATTCCTAAAGAGCAGAAGTACTCTTT CCTGCAAAACCCACAGACTTCTCTCTGCTTCAGCGAATCTATTC CGACGCCTTCCAATCGCGAGGAAACTCAGCAAAAGTCCAATCT GGAACTACTCCGCATTTCTCTGCTTCTGATTCAGAGCTGGCTAG AACCAGTGCAATTTCTGCGTTCCGTCTTCGCCAATAGCCTAGTT TATGGCGCATCCGACAGCAACGTATACGATCTCCTGAAAGATC TCGAGGAAGGCATTCAGACCCTGATGGGTCGTCTCGAGGATGG CTCTCCGCGTACTGGTCAGATCTTCAAGCAGACTTACTCTAAAT TTGATACTAACAGCCACAATGACGATGCGCTTCTAAAAAACTA TGGTCTGCTGTATTGTTTCGTAAAGATATGGACAAAGTTGAAA CCTTCCTGCGTATTGTTCAGTGTCGTTCCGTTGAGGGCAGCTGT GGTTTCTAA | 674 |
| AE288-hGH | GTSESATPESGPGSE PATSGSETPGTSESA TPESGPGSEPATSGS ETPGTSESATPESGP GTSTEPSEGSAPGSP AGSPTSTEEGTSESA TPESGPGSEPATSGS ETPGTSESATPESGP GSPAGSPTSTEEGSP AGSPTSTEEGTSTEPS EGSAPGTSESATPES GPGTSESATPESGPG TSESATPESGPGSEP ATSGSETPGSEPATS GSETPGSPAGSPTST EEGTSTEPSEGSAPG TSTEPSEGSAPGSEP ATSGSETPGTSESAT PESGPGTSTEPSEGS APGFPTIPLSRLFDNA MLRAHRLHQLAFDT YQEFEEAYIPKEQKY SFLQNPQTSLCFSESI PTPSNREETQQKSNL ELLRISLLLIQSWLEP VQFLRSVFANSLVY GASDSNVYDLLKDL EEGIQTLMGRLEDGS PRTGQIFKQTYSKFD TNSHNDDALLKNYG LLYCFRKDMDKVET FLRIVQCRSVEGSCGF | 675 | GGTACCTCTGAAAGCGCAACTCCTGAGTCTGGCCCAGGTAGCG AACCTGCTACCTCCGGCTCTGAGACTCCAGGTACCTCTGAAAGC GCAACCCCGGAATCTGGTCCAGGTAGCGAACCTGCAACCTCTG GCTCTGAAACCCCAGGTACCTCTGAAAGCGCTACTCCTGAATCT GGCCCAGGTACTTCTACTGAACCGTCCGAGGGCAGCGCACCAG GTAGCCCTGCTGGCTCTCCAACCTCCACCGAAGAAGGTACCTCT GAAAGCGCAACCCCTGAATCCGGCCCAGGTAGCGAACCGGCAA CCTCCGGTTCTGAAACCCCAGGTACTTCTGAAAGCGCTACTCCT GAGTCCGGCCCAGGTAGCCCGGCTGGCTCTCCGACTTCCACCG AGGAAGGTAGCCCGGCTGGCTCTCCAACTTCTACTGAAGAAGG TACTTCTACCGAACCTTCCGAGGGCAGCGCACCAGGTACTTCTG AAAGCGCTACCCCTGAGTCCGGCCCAGGTACTTCTGAAAGCGC TACTCCTGAATCCGGTCCAGGTACTTCTGAAAGCGCTACCCCGG AATCTGGCCCAGGTAGCGAACCGGCTACTTCTGGTTCTGAAACC CCAGGTAGCGAACCGGCTACCTCCGGTTCTGAAACTCCAGGTA GCCCAGCAGGCTCTCCGACTTCCACTGAGGAAGGTACTTCTACT GAACCTTCCGAAGGCAGCGCACCAGGTACCTCTACTGAACCTT CTGAGGGCAGCGCTCCAGGTAGCGAACCTGCAACCTCTGGCTC TGAAACCCCAGGTACCTCTGAAAGCGCTACTCCTGAATCTGGCC CAGGTACTTCTACTGAACCGTCCGAGGGCAGCGCACCAGGTTTT CCGACTATTCCGCTGTCTCGTCTGTTTGATAATGCTATGCTGCGT GCGCACCGTCTGCACCAGCTGGCTTTTGATACTTACCAGGAATT TGAAGAAGCcTACATTCCTAAAGAGCAGAAGTACTCTTTCCTGC AAAACCCACAGACTTCTCTCTGCTTCAGCGAATCTATTCCGACG CCTTCCAATCGCGAGGAAACTCAGCAAAAGTCCAATCTGGAAC TACTCCGCATTTCTCTGCTTCTGATTCAGAGCTGGCTAGAACCA GTGCAATTTCTGCGTTCCGTCTTCGCCAATAGCCTAGTTTATGG CGCATCCGACAGCAACGTATACGATCTCCTGAAAGATCTCGAG GAAGGCATTCAGACCCTGATGGGTCGTCTCGAGGATGGCTCTC CGCGTACTGGTCAGATCTTCAAGCAGACTTACTCTAAATTTGAT ACTAACAGCCACAATGACGATGCGCTTCTAAAAAACTATGGTC TGCTGTATTGTTTCGTAAAGATATGGACAAAGTTGAAACCTTC CTGCGTATTGTTCAGTGTCGTTCCGTTGAGGGCAGCTGTGGTTT CTAA | 676 |
| AF144-hGH | GTSTPESGSASPGTSP SGESSTAPGTSPSGES STAPGSTSSTAESPGP GSTSESPSGTAPGSTS STAESPGPGTSPSGES STAPGTSTPESGSASP GSTSSTAESPGPGTSP SGESSTAPGTSPSGES STAPGTSPSGESSTAP GFPTIPLSRLFDNAM LRAHRLHQLAFDTY QEFEEAYTPKEQKYS FLQNPQTSLCFSESIP TPSNREETQQKSNLE LLRISLLLIQSWLEPV | 677 | GGTACTTCTACTCCGGAAAGCGGTTCCGCATCTCCAGGTACTTC TCCTAGCGGTGAATCTTCTACTGCTCCAGGTACCTCTCCTAGCG GCGAATCTTCTACTGCTCCAGGTTCTACCAGCTCTACCGCTGAA TCTCCTGGCCCAGGTTCTACCAGCGAATCCCCGTCTGGCACCGC ACCAGGTTCTACTAGCTCTACCGCAGAATCTCCGGGTCCAGGTA CTTCCCCTAGCGGTGAATCTTCTACTGCTCCAGGTACCTCTACT CCGGAAAGCGGCTCCGCATCTCCAGGTTCTACTAGCTCTACTGC TGAATCTCCTGGTCCAGGTACCTCCCCTAGCGGCGAATCTTCTA CTGCTCCAGGTACCTCTCCTAGCGGCGAATCTTCTACCGCTCCA GGTACTCCCCTAGCGGTGAATCTTCTACCGCACCAGGTTTTCC GACTATTCCGCTGTCTCGTCTGTTTGATAATGCTATGCTGCGTG CGCACCGTCTGCACCAGCTGGCTTTTGATACTTACCAGGAATTT GAAGAAGCcTACATTCCTAAAGAGCAGAAGTACTCTTTCCTGCA AAACCCACAGACTTCTCTCTGCTTCAGCGAATCTATTCCGACGC CTTCCAATCGCGAGGAAACTCAGCAAAAGTCCAATCTGGAACT | 678 |

TABLE 35-continued

Exemplary GHXTEN comprising growth hormones and single XTEN

| GHXTEN Name* | Amino Acid Sequence | SEQ ID NO: | DNA Nucleotide Sequence | SEQ ID NO: |
|---|---|---|---|---|
| | QFLRSVFANSLVYG ASDSNVYDLLKDLE EGIQTLMGRLEDGSP RTGQIFKQTYSKFDT NSHNDDALLKNYGL LYCFRKDMDKVETF LRIVQCRSVEGSCGF | | ACTCCGCATTTCTCTGCTTCTGATTCAGAGCTGGCTAGAACCAG TGCAATTTCTGCGTTCCGTCTTCGCCAATAGCCTAGTTTATGGC GCATCCGACAGCAACGTATACGATCTCCTGAAAGATCTCGAGG AAGGCATTCAGACCCTGATGGGCGTCTCGAGGATGGCTCTCC GCGTACTGGTCAGATCTTCAAGCAGACTTACTCTAAATTTGATA CTAACAGCCACAATGACGATGCGCTTCTAAAAAACTATGGTCT GCTGTATTGTTTTCGTAAAGATATGGACAAAGTTGAAACCTTCC TGCGTATTGTTCAGTGTCGTTCCGTTGAGGGCAGCTGTGGTTTC TAA | |
| AD576-hGH | GSSESGSSEGGPGSG GEPSESGSSGSSESGS SEGGPGSSESGSSEG GPGSSESGSSEGGPG SSESGSSEGGPGSSES GSSEGGPGESPGGSS GSESGSSEGSSGPGES SGSSESGSSEGGPGS SESGSSEGGPGSSES GSSEGGPGSSGGEPSE SGSSGESPGGSSGSE SGESPGGSSGSESGS GGEPSESGSSGSSES GSSEGGPGSSGGEPSE SGSSGSGGEPSESGS SGSEGSSGPGESSGE SPGGSSGSESGSGGE PSESGSSGSGGEPSES GSSESGSSEGGPGES PGGSSGSESGESPGG SSGSESGESPGGSSG SESGESPGGSSGSESGSS ESGSSEGGPGSGGEP SESGSSGSEGSSGPG ESSGSSESGSSEGGP GSGGEPSESGSSGSS ESGSSEGGPGSGGEP SESGSSGESPGGSSG SESGESPGGSSGSES GSSESGSSEGGPGSG GEPSESGSSGSSESGS SEGGPGSGGEPSESG SSGSGGEPSESGSSG ESPGGSSGSESGSEG SSGPGESSGSESGSS EGGPGSEGSSGPGES SGFPTIPLSRLFDNA MLRAHRLHQLAFDT YQEFEEAYIPKEQKY SFLQNPQTSLCFSESI PTPSNREETQQKSNL ELLRISLLLIQSWLEP VQFLRSVFANSLVY GASDSNVYDLLKDL EEGIQTLMGRLEDGS PRTGQIFKQTYSKFD TNSHNDDALLKNYG LLYCFRKDMDKVET FLRIVQCRSVEGSCGF | 679 | GGTTCCTCTGAAAGCGGTTCTTCCGAAGGTGGTCCAGGTTCCTC TGAAAGCGGTTCTTCTGAGGGTGGTCCAGGTGAATCTCCGGGT GGCTCCAGCGGTTCCGAGTCAGGTTCTGGTGGCGAACCTTCCGA GTCTGGTAGCTCAGGTGAATCTCCGGGTGGTTCTAGCGGTTCCG AGTCAGGTGAATCTCCGGGTGGTTCCAGCGGTTCTGAGTCAGGT TCCTCCGAAAGCGGTTCTTCTGAGGGCGGTCCAGGTTCCTCCGA AAGCGGTTCTTCCGAGGGCGGTCCAGGTCTTCTGAAAGCGGTT CTTCCGAGGGCGGTCCAGGTGAATCTCCGGTGGTTCCAGCGGT TCCGAGTCAGGTGAATCTCCAGGTGGCTCTAGCGGTTCCGAGTC AGGTGAATCTCCGGTGGTTCTAGCGGTTCTGAATCAGGTTCCT CCGAAAGCGGTTCTTCTGAGGGCGGTCCAGGTTCCTCCGAAAG CGGTTCTTCCGAGGGCGGTCCAGGTTCTTCTGAAAGCGGTTCTT CCGAGGGCGGTCCAGGTTCCTCTGAAAGCGGTTCTTCTGAGGG CGGTCCAGGTTCTTCCGAAAGCGGTTCTTCCGAGGGCGGTCCAG GTTCTTCCGAAAGCGGTTCTTCTGAAGGCGGTCCAGGTTCTGGT GGCGAACCGTCCGAGTCTGGTAGCTCAGGTGAATCTCCGGGTG GCTCTAGCGGTTCCGAGTCAGGTGAATCTCCTGGTGGTTCCAGC GGTTCCGAGTCAGGTTCCGGTGGCGAACCGTCCGAATCTGGTA GCTCAGGTAGCGAAGGTTCTTCTGGTCCAGGCGAATCTTCAGGT TCCTCTGAAAGCGGTTCTTCTGAGGGCGGTCCAGGTTCCGGTGG CGAACCGTCCGAATCTGGTAGCTCAGGTAGCGAAGGTTCTTCTG GTCCAGGCGAATCTTCAGGTTCCTCTGAAAGCGGTTCTTCTGAG GGCGGTCCAGGTTCTGGTGGCGAACCTTCCGAATCTGGTAGCTC AGGTGAATCTCCGGGTGGTTCTAGCGGTTCTGAGTCAGGTTCTG GTGGTGAACCTTCCGAGTCTGGTAGCTCAGGTTCTGGTGGCGAA CCATCCGAGTCTGGTAGCTCAGGTTCTTCCGAAAGCGGTTCTTC CGAAGGCGGTCCAGGTTCTGGTGGTGAACCGTCCGAATCTGGT AGCTCAGGTTCTGGTGGCGAACCATCCGAATCTGGTAGCTCAG GTAGCGAAGGTTCTTCTGGTCCTGGCGAATCTTCAGGTGAATCT CCAGGTGGCTCTAGCGGTTCCGAATCAGGTAGCGAAGGTTCTTC CGGTCCAGGTGAATCTTCAGGTAGCGAAGGTTCTTCTGGTCCTG GTGAATCCTCAGGTTCCGGTGGCGAACCATCCGAATCTGGTAGC TCAGGTTCCTCTGAAAGCGGTTCTTCCGAAGGTGGTCCAGGTTC CTGAAAGCGGTTCTTCTGAGGGTGGTCCAGGTGAATCTCCGG GTGGCTCCAGCGGTTCCGAGTCAGGTTCTGGTGGCGAACCATCC GAATCTGGTAGCTCAGGTAGCGAAGGTTCTTCTGGTCCTGGCGA ATCTTCAGGTGAATCTCCAGGTGGCTCTAGCGGTTCCGAATCAG GTAGCGAAGGTTCTTCCGGTCCTGGTGAGTCTTCAGGTGAATCT CCAGGTGGCTCAGGTGAGTCAGGTAGCGAAGGTTCTTC TGGTCCTGGCGAGTCCTCAGGTTTTCCGACTATTCCGCTGTCTC GTCTGTTTGATAATGCTATGCTGCGTGCGCACCGTCTGCACCAG CTGGCCTTTGATACTTACCAGGAATTTGAAGAAGCcTACATTCC TAAAGAGCAGAAGTACTCTTTCCTGCAAAACCCACAGACTTCTC TCTGCTTCAGCGAATCTATTCCGACGCCTTCCAATCGTGAGGAA ACTCAGCAAAAGTCCAATCTGGAACTACTCCGCATTTCTCTGCT TCTGATTCAGAGCTGGCTAGAACCAGTGCAATTTCTGCGTTCCG TCTTCGCCAATAGCCTAGTTTATGGCGCATCCGACAGCAACGTA TACGATCTCCTGAAAGATCTCGAGGAAGGCATTCAGACCCTGA TGGGTCGTCTCGAGGATGGCTCTCCGCGTACTGGTCAGATCTTC AAGCAGACTTACTCTAAATTTGATACTAACAGCCACAATGACG ATGCGCTTCTAAAAAACTATGGTCTGCTGTATTGTTTTCGTAAA GATATGGACAAAGTTGAAACCTTCCTGCGTATTGTTCAGTGTCG TTCCGTTGAGGGCAGCTGTGGTTTCTAA | 680 |
| AE576-hGH | GSPAGSPTSTEEGTS ESATPESGPGTSTEPS EGSAPGSPAGSPTST EEGTSTEPSEGSAPG TSTEPSEGSAPGTSES ATPESGPGSEPATSG SETPGSEPATSGSETP GSPAGSPTSTEEGTS ESATPESGPGTSTEPS EGSAPGTSTEPSEGS APGSPAGSPTSTEEG | 681 | GGTAGCCCGGCTGGCTCTCCTACCTCTACTGAGGAAGGTACTTC TGAAAGCGCTACTCCTGAGTCTGGTCCAGGTACCTCTACTGAAC CGTCCGAAGGTAGCGCTCCAGGTAGCCCAGCAGGCTCTCCGAC TTCCACTGAGGAAGGTACTTCTACTGAACCTTCCGAAGGCAGC GCACCAGGTACCTCTACTGAACCTTCTGAGGGCAGCGCTCCAG GTACTTCTGAAAGCGCTACCCCGGAATCTGGCCCAGGTAGCGA ACCGGCTACTTCTGGTTCTGAAACCCCAGGTAGCGAACCGGCT ACCTCCGGTTCTGAAACTCCAGGTAGCCCGGCAGGCTCTCCGAC CTCTACTGAGGAAGGTACTTCTGAAAGCGCAACCCCGGAGTCC GGCCCAGGTACCTCTACCGAACCGTCTGAGGGCAGCGCACCAG GTACTTCTACCGAACCGTCCGAGGGTAGCGCACCAGGTAGCCC | 682 |

TABLE 35-continued

Exemplary GHXTEN comprising growth hormones and single XTEN

| GHXTEN Name* | Amino Acid Sequence | SEQ ID NO: | DNA Nucleotide Sequence | SEQ ID NO: |
|---|---|---|---|---|
| | TSTEPSEGSAPGTSTE PSEGSAPGTSESATP ESGPGTSTEPSEGSA PGTSESATPESGPGS EPATSGSETPGTSTEP SEGSAPGTSTEPSEG SAPGTSESATPESGP GTSESATPESGPGSP AGSPTSTEEGTSESA TPESGPGSEPATSGS ETPGTSESATPESGP GTSTEPSEGSAPGTS TEPSEGSAPGTSTEPS EGSAPGTSTEPSEGS APGTSTEPSEGSAPG TSTEPSEGSAPGSPA GSPTSTEEGTSTEPSE GSAPGTSESATPESG PGSEPATSGSETPGT SESATPESGPGSEPA TSGSETPGTSESATPE SGPGTSTEPSEGSAP GTSESATPESGPGSP AGSPTSTEEGSPAGS PTSTEEGSPAGSPTST EEGTSESATPESGPG TSTEPSEGSAPGFPTI PLSRLFDNAMLRAH RLHQLAFDTYQEFEE AYIPKEQKYSFLQNP QTSLCFSESIPTPSNR EETQQKSNLELLRIS LLLIQSWLEPVQFLR SVFANSLVYGASDS NVYDLLKDLEEGIQT LMGRLEDGSPRTGQI FKQTYSKFDTNSHN DDALLKNYGLLYCF RKDMDKVETFLRIV QCRSVEGSCGF | | AGCAGGTTCTCCTACCTCCACCGAGGAAGGTACTTCTACCGAAC CGTCCGAGGGTAGCGCACCAGGTACCTCTACTGAACCTTCTGA GGGCAGCGCTCCAGGTACTTCTGAAAGCGCTACCCCGGAGTCC GGTCCAGGTACTTCTACTGAACGTCCGAAGGTAGCGCACCAG GTACTTCTGAAAGCGCAACCCCTGAATCCGGTCCAGGTAGCGA ACCGGCTACTTCTGGCTCTGAGACTCCAGGTACTTCTACCGAAC CGTCCGAAGGTAGCGCACCAGGTACTTCTACTGAACCGTCTGA AGGTAGCGCACCAGGTACTTCTGAAAGCGCAACCCCGGAATCC GGCCCAGGTACCTCTGAAAGCGCAACCCCGGAGTCCGGCCCAG GTAGCCCTGCTGGCTCTCCAACCTCCACCGAAGAAGGTACCTCT GAAAGCGCAACCCCTGAATCCGGCCCAGGTAGCGAACCGGCAA CCTCCGGTTCTGAAACCCCAGGTACTTCTGAAAGCGCTACTCCG GAGTCTGGCCCAGGTACCTCTACTGAACCGTCTGAGGGTAGCG CTCCAGGTACTTCTACTGAACCGTCCGAAGGTAGCGCACCAGG TACTTCTACCGAACCGTCCGAAGGCAGCGCTCCAGGTACCTCTA CTGAACCTTCCGAGGGCAGCGCTCCAGGTACCTCTACCGAACCT TCTGAAGGTAGCGCACCAGGTACTTCTACCGAACCGTCCGAGG GTAGCGCACCAGGTAGCCCAGCAGGTTCTCCTACCTCCACCGA GGAAGGTACTTCTACCGAACCGTCCGAGGGTAGCGCACCAGGT ACCTCTGAAAGCGCAACTCCTGAGTCTGGCCCAGGTAGCGAAC CTGCTACCTCCGGCTCTGAGACTCCAGGTACCTCTGAAAGCGCA ACCCCGGAATCTGGTCCAGGTAGCGAACCTGCAACCTCTGGCT CTGAAACCCCAGGTACCTCTGAAAGCGCTACTCCTGAATCTGGC CCAGGTACTTCTACTGAACCGTCCGAGGGCAGCGCACCAGGTA CTTCTGAAAGCGCTACTCCTGAGTCCGGCCCAGGTAGCCCGGCT GGCTCTCCGACTTCCACCGAGGAAGGTAGCCCGGCTGGCTCTCC AACTTCTACTGAAGAAGGTAGCCCGGCAGGCTCTCCGACCTCT ACTGAGGAAGGTACCTCTGAAAGCGCAACCCCGGAGTCCGGCC CAGGTACCTCTACCGAACCGTCTGAGGGCAGCGCACCAGGTTT TCCGACTATTCCGCTGTCTCGTCTGTTTGATAATGCTATGCTGCG TGCGCACCGTCTGCACCAGCTGGCCTTTGATACTTACCAGGAAT TTGAAGAAGCcTACATTCCTAAAGAGCAGAAGTACTCTTTCCTG CAAAACCCACGACTTCTCTCTGCTTCAGCGAATCTATTCCGAC GCCTTCCAATCGCGAGGAAACTCAGCAAAAGTCCAATCTGGAA CTACTCCGCATTTCTCTGCTTCTGATTCAGAGCTGGCTAGAACC AGTGCAATTTCTGCGTTCCGTCTTCGCCAATAGCCTAGTTTATG GCGCATCCGACGCAACGTATACGATCTCCTGAAAGATCTCGA GGAAGGCATTCAGACCCTGATGGGTCGTCTCGAGGATGGCTCT CCGCGTACTGGTCAGATCTTCAAGCAGACTTACTCTAAATTTGA TACTAACAGCCACAATGACGATGCGCTTCTAAAAAACTATGGT CTGCTGTATTGTTTTCGTAAAGATATGGACAAAGTTGAAACCTT CCTGCGTATTGTTCAGTGTCGTTCCGTTGAGGGCAGCTGTGGTT TCTAA | |
| AF576- hGH | GSTSSTAESPGPGSTS STAESPGPGSTSESPS GTAPGSTSSTAESPG PGSTSSTAESPGPGTS TPESGSASPGSTSESP SGTAPGTSPSGESST APGSTSESPSGTAPG STSESPSGTAPGTSPS GESSTAPGSTSESPSG TAPGSTSESPSGTAP GTSPSGESSTAPGSTS ESPSGTAPGSTSESPS GTAPGSTSESPSGTA PGTSTPESGSASPGST SESPSGTAPGSTPES GSASPGSTSSTAESP GPGSTSSTAESPGPG TSTPESGSASPGTSTP ESGSASPGSTSESPSG TAPGTSTPESGSASP GTSTPESGSASPGSTS ESPSGTAPGSTSESPS GTAPGSTSESPSGTA PGSTSSTAESPGPGTS TPESGSASPGTSTPES GSASPGSTSESPSGT APGSTSESPSGTAPG TSTPESGSASPGSTSE SPSGTAPGSTSESPSG TAPGTSTPESGSASP GTSPSGESSTAPGSTS | 683 | GGTTCTACTAGCTCTACCGCTGAATCTCCTGGCCCAGGTTCCAC TAGCTCTACCGCAGAATCTCCGGGCCCAGGTTCTACTAGCGAAT CCCCTTCTGGTACCGCTCCAGGTTCTACTAGCTCTACCGCTGAA TCTCCGGGTCCAGGTTCTACCAGCTCTACTGCAGAATCTCCTGG CCCAGGTACTTCTACTCCGGAAAGCGGTTCCGCTTCTCCAGGTT CTACCAGCGAATCTCCTTCTGGCACCGCTCCAGGTACCTCTCCT AGCGGCGAATCTTCTACCGCTCCAGGTTCTACTAGCGAATCTCC TTCTGGCACTGCACCAGGTTCTACCAGCGAATCTCCTTCTGGCA CCGCTCCAGGTACCTCTCCTAGCGGCGAATCTTCTACCGCTCCA GGTTCTACTAGCGAATCTCCTTCTGGCACTGCACCAGGTTCTAC CAGCGAATCTCCTTCTGGCACCGCTCCAGGTACCTCTCCTAGCG GCGAATCTTCTACCGCTCCAGGTTCTACTAGCGAATCTCCTTCT GGCACTGCACCAGGTTCTACTAGCGAATCTCCTTCTGGCACTGC ACCAGGTTCTACCAGCGAATCTCCGTCTGGCACTGCACCAGGTA CCTCTACCCCTGAAAGCGGTTCCGCTTCTCCAGGTTCTACTAGC GAATCTCCTTCTGGTACCGCTCCAGGTACTTCTACCCCTGAAAG CGGCTCCGCTTCTCCAGGTTCCACTAGCTCTACCGCTGAATCTC CGGGTCCAGGTTCTACTAGCTCTACTGCAGAATCTCCTGGCCCA GGTACCTCTACTCCGGAAAGCGGCTCTGCATCTCCAGGTACTTC TACCCCTGAAAGCGGTTCTGCATCTCCAGGTTCTACTAGCGAAT CCCCGTCTGGTACCGCACCAGGTACTTCTACCCCGGAAAGCGG CTCTGCTTCTCCAGGTACTTCTACCCCGGAAAGCGGCTCTGCAT CTCCAGGTTCTACTAGCGAATCTCCTTCTGGTACCGCTCCAGGT TCTACCAGCGAATCCCCGTCTGGTACTGCTCCAGGTTCTACCAG CGAATCTCCTTCTGGTACTGCACCAGGTTCTACTAGCTCTACTG CAGAATCTCCGGGTCCAGGTACTTCTACCCCGGAAAGCGGAAG GCATCTCCAGGTACTTCTACCCCTGAAAGCGGTTCTGCATCTCC AGGTTCTACTAGCGAATCTCCTTCTGGCACTGCACCAGGTTCTA CCAGCGAATCTCCGTCTGGCACTGCACCAGGTACCTCTACCCCT GAAAGCGGTTCCGCTTCTCCAGGTTCTACTAGCGAATCTCCTTC TGGCACTGCACCAGGTTCTACCAGCGAATCTCCGTCTGGCACTG | 684 |

TABLE 35-continued

Exemplary GHXTEN comprising growth hormones and single XTEN

| GHXTEN Name* | Amino Acid Sequence | SEQ ID NO: | DNA Nucleotide Sequence | SEQ ID NO: |
|---|---|---|---|---|
| | STAESPGPGTSPSGES STAPGSTSSTAESPGP GTSTPESGSASPGSTS ESPSGTAPGSTSSTA ESPGPGTSTPESGSAS PGTSTPESGSASPGFP TIPLSRLFDNAMLRA HRLHQLAFDTYQEF EEAYIPKEQKYSFLQ NPQTSLCFSESIPTPS NREETQQKSNLELLR ISLLLIQSWLEPVQFL RSVFANSLVYGASD SNVYDLLKDLEEGIQ TLMGRLEDGSPRTG QIFKQTYSKFDTNSH NDDALLKNYGLLYC FRKDMDKVETFLRI VQCRSVEGSCGF | | CACCAGGTACCTCTACCCCTGAAAGCGGTTCCGCTTCTCCAGGT ACTTCTCCGAGCGGTGAATCTTCTACCGCACCAGGTTCTACTAG CTCTACCGCTGAATCTCCGGGCCCAGGTACTTCTCCGAGCGGTG AATCTTCTACTGCTCCAGGTTCCACTAGCTCTACTGCTGAATCT CCTGGCCCAGGTACTTCTACTCCGGAAAGCGGTTCCGCTTCTCC AGGTTCTACTAGCGAATCTCCGTCTGGCACCGCACCAGGTTCTA CTAGCTCTACTGCAGAATCTCCTGGCCCAGGTACCTCTACTCCG GAAAGCGGCTCTGCATCTCCAGGTACTTCTACCCCTGAAAGCG GTTCTGCATCTCCAGGTTTTCCGACTATTCCGCTGTCTCGTCTGT TTGATAATGCTATGCTGCGTGCGCACCGTCTGCACCAGCTGGCC TTTGATACTTACCAGGAATTTGAAGAAGcTACATTCCTAAAGA GCAGAAGTACTCTTTCCTGCAAAACCCACAGACTTCTCTCTGC TCAGCGAATCTATTCCGACGCCTTCCAATCGCGAGGAAACTCA GCAAAGTCCAATCTGGAACTACTCCGCATTTCTCTGCTTCTGA TTCAGAGCTGGCTAGAACCAGTGCAATTTCTGCGTTCCGTCTTC GCCAATAGCCTAGTTTATGGCGCATCCGACAGCAACGTATACG ATCCTGAAAGATCTCGAGGAAGGCATTCAGACCCTGATGGG TCGTCTCGAGGATGGCTCTCCGCGTACTGGTCAGATCTTCAAGC AGACTTACTCTAAATTTGATACTAACAGCCACAATGACGATGC GCTTCTAAAAAACTATGGTCTGCTGTATTGTTTTCGTAAAGATA TGGACAAAGTTGAAACCTTCCTGCGTATTGTTCAGTGTCGTTCC GTTGAGGGCAGCTGTGGTTTCTAA | |
| AE624-hGH | MAEPAGSPTSTEEGT PGSGTASSSPGSSTPS GATGSPGASPGTSST GSPGSPAGSPTSTEE GTSESATPESGPGTS TEPSEGSAPGSPAGS PTSTEEGTSTEPSEGS APGTSTEPSEGSAPG TSESATPESGPGSEP ATSGSETPGSEPATS GSETPGSPAGSPTST EEGTSESATPESGPG TSTEPSEGSAPGTSTE PSEGSAPGSPAGSPT STEEGTSTEPSEGSAP GTSTEPSEGSAPGTS ESATPESGPGTSTEPS EGSAPGTSESATPES GPGSEPATSGSETPG TSTEPSEGSAPGTSTE PSEGSAPGTSESATP ESGPGTSESATPESG PGSPAGSPTSTEEGT SESATPESGPGSEPA TSGSETPGTSESATPE SGPGTSTEPSEGSAP GTSTEPSEGSAPGTS TEPSEGSAPGTSTEPS EGSAPGTSTEPSEGS APGTSTEPSEGSAPG SPAGSPTSTEEGTSTE PSEGSAPGTSESATP ESGPGSEPATSGSET PGTSESATPESGPGS EPATSGSETPGTSES ATPESGPGTSTEPSE GSAPGTSESATPESG PGSPAGSPTSTEEGSP AGSPTSTEEGSPAGS PTSTEEGTSESATPES GPGTSTEPSEGSAPG FPTIPLSRLFDNAML RAHRLHQLAFDTYQ EFEEAYIPKEQKYSF LQNPQTSLCFSESIPT PSNREETQQKSNLEL LRISLLLIQSWLEPVQ FLRSVFANSLVYGAS DSNVYDLLKDLEEGI QTLMGRLEDGSPRT GQIFKQTYSKFDTNS HNDDALLKNYGLLY | 685 | ATGGCTGAACCTGCTGGCTCTCCAACCTCCACTGAGGAAGGTA CCCCGGGTAGCGGTACTGCTTCTTCCTCTCCAGGTAGCTCTACC CCTTCTGGTGCAACCGGCTCTCCAGGTGCTTCTCCGGGCACCAG CTACCGGTTCTCCAGGTAGCCCGGCTGGCTCTCCTACCTCTA CTGAGGAAGGTACTTCTGAAAGCGCTACTCCTGAGTCTGGTCCA GGTACCTCTACTGAACCGTCCGAAGGTAGCGCTCCAGGTAGCC CAGCAGGCTCTCCGGACTTCCACTGAGGAAGGTACTTCTACTGAA CCTTCCGAAGGCAGCGCACCAGGTACCTCTACTGAACCTTCTGA GGGCAGCGCTCCAGGTACTTCTGAAAGCGCTACCCCGGAATCT GGCCCAGGTAGCGAACCGGCTACTTCTGGTTCTGAAACCCAG GTAGCGAACCGGCTACCTCCGGTTCTGAAACTCCAGGTAGCCCC GGCAGGCTCTCCGACCTCTACTGAGGAAGGTACTTCTGAAAGC GCAACCCCGGAGTCCGGCCCAGGTACCTCTACCGAACCGTCTG AGGGCAGCGCACCAGGTACTTCTGAACCGTCCGAGGGTAG CGCACCAGGTAGCCCAGCAGGTTCTCCTACCTCCACCGAGGAA GGTACTTCTACCGAACCGTCCGAGGGTAGCGCACCAGGTACCT CTACTGAACCTTCTGAGGGCAGCGCTCCAGGTACTTCTGAAAGC GCTACCCCGGAGTCCGGTCCAGGTACTTCTACTGAACCGTCGA AGGTAGCGCACCAGGTACTTCTGAAAGCGCAACCCCTGAATCC GGTCCAGGTAGCGAACCGGCTACTTCTGGCTCTGAGACTCCAG GTACTTCTACCGAACCGTCCGAAGGTAGCGCACCAGGTACTTCT ACTGAACCGTCTGAAGGTAGCGCACCAGGTACTTCTGAAGCG CAACCCCGGAATCCGGCCCAGGTACCTCTGAAAGCGCAACCCC GGAGTCCGGCCCAGGTAGCCCTGCTGGCTCTCCAACCTCCACCG AAGAAGGTACTTCTGAAAGCGCAACCCCTGAATCCGGCCCAGG TAGCGAACCGGCAACCTCCGGTTCTGAAACCCCAGGTACCTCT GAAAGCGCTACTCCGGAGTCTGGCCCAGGTACCTCTACTGAAC CGTCTGAGGGTAGCGCTCCAGGTACTTCTACTGAACCGTCCGAA GGTAGCGCACCAGGTACTTCTACCGAACCGTCCGAAGGCAGCG CTCCAGGTACCTCTACTGAACCTTCCGAGGGCAGCGCTCCAGG ACCTCTACCGAACCTTCTGAAGGTAGCGCACCAGGTACTTCTAC CGAACCGTCCGAGGGTAGCGCACCAGGTAGCCCAGCAGGTTCT CCTACCTCCACCGAGGAAGGTACTTCTACCGAACCGTCCGAGG GTAGCGCACCAGGTACCTCTGAAAGCGCAACTCCTGAGTCTGG CCCAGGTAGCGAACCTGCTACCTCCGGCTCTGAGACTCCAGGT ACCTCTGAAAGCGCAACCCCGGAATCTGGTCCAGGTAGCGAAC CTGCAACCTCTGGCTCTGAAACCCCAGGTACCTCTGAAAGCGCT ACTCCTGAATCTGGCCCAGGTACTTCTACTGAACCGTCCGAGGG CAGCGCACCAGGTACTTCTGAAGTCGCTACTCCTGAGTCCGGG CCAGGTAGCCCGGCTGGCTCTCCGACTTCCACCGAGGAAGGTA GCCCGGCTGGCTCTCCAACTTCTACTGAAGAAGGTAGCCCGGC AGGCTCTCCGACCTCTACTGAGGAAGGTACTTCTGAAAGCGCA ACCCCGGAGTCCGGCCCAGGTACCTCTACCGAACCGTCTGAGG GCAGCGCACCAGGTTTTCCGACTATTCCGCTGTCTCGTCTGTTT GATAATGCTATGCTGCGTGCGCACCGTCTGCACCAGCTGGCCTT TGATACTTACCAGGAATTTGAAGAAGcTACATTCCTAAAGAGC AGAAGTACTCTTTCCTGCAAAACCCACAGACTTCTCTGCTTC AGCGAATCTATTCCGACGCCTTCCAATCGCGAGGAAACTCAGC AAAAGTCCAATCTGGAACTACTCCGCATTTCTCTGCTTCTGATT CAGAGCTGGCTAGAACCAGTGCAATTTCTGCGTTCCGTCTTCGC CAATAGCCTAGTTTATGGCGCATCCGACAGCAACGTATACGAT CCTGAAAGATCTCGAGGAAGGCATTCAGACCCTGATGGGTC | 686 |

TABLE 35-continued

Exemplary GHXTEN comprising growth hormones and single XTEN

| GHXTEN Name* | Amino Acid Sequence | SEQ ID NO: | DNA Nucleotide Sequence | SEQ ID NO: |
|---|---|---|---|---|
| | CFRKDMDKVETFLRI VQCRSVEGSCGF | | GTCTCGAGGATGGCTCTCCGCGTACTGGTCAGATCTTCAAGCAG ACTTACTCTAAATTTGATACTAACAGCCACAATGACGATGCGCT TCTAAAAAACTATGGTCTGCTGTATTGTTTTCGTAAAGATATGG ACAAAGTTGAAACCTTCCTGCGTATTGTTCAGTGTCGTTCCGTT GAGGGCAGCTGTGGTTTCTAA | |
| AD836-hGH | GSSESGSSEGGPGSS ESGSSEGGPGESPGG SSGSESGSGGEPSES GSSGESPGGSSGSES GESPGGSSGSESGES ESGSSEGGPGSSESG SSEGGPGSSESGSSE GGPGESPGGSSGSES GESPGGSSGSESGES PGGSSGSESGSSESG SSEGGPGSSESGSSE GGPGSSESGSSEGGP GSSESGSSEGGPGSS ESGSSEGGPGSSESG SSEGGPGSGGEPSES GSSGESPGGSSGSES GESPGGSSGSESGSG GEPSESGSSGSEGSS GPGESSGSSESGSSE GGPGSGGEPSESGSS GSEGSSGPGESSGSS ESGSSEGGPGSSGEP SESGSSGGEPSESGSS GSGGEPSESGSSGSS ESGSSEGGPGSGGEP SESGSSGGEPSES GSSGSEGSSGPGESS GESPGGSSGSESGSE GSSGPGESSGSEGSS GPGESSGGEPSES GSSGSSESGSSEGGP GSSESGSSEGGPGES PGGSSGSESGSGGEP SESGSSEGSSEGGPG SESGSSGSGGEPSES ESSGESPGGSSGSES GSEGSSGPGSSESGS SEGGPGSGGEPSESG SSGSSESGPGESSG SEGSSGPGESSGSEG SSGPGESSGSGGEPS ESGSSGSGGEPSESG SSGSPGESSGSESG ESPGGSSGSESGSGG EPSESGSSGFPTIP LSRLFDNAMLRAHR LHQLAFDTYQEFEE AYIPKEQKYSFLQNP QTSLCFSESIPTPSNR EETQQKSNLELLRIS LLLIQSWLEPVQFLR SVFANSLVYGASDS NVYDLLKDLEEGIQT LMGRLEDGSPRTGQI FKQTYSKFDTNSHN DDALLKNYGLLYCF RKDMDKVETFLRIV QCRSVEGSCGF | 687 | GGTTCCTCTGAAAGCGGTTCTTCCGAAGGTGGTCCAGGTTCCTC TGAAAGCGGTTCTTCTGAGGGTGGTCCAGGTGAATCTCCGGGT GGCTCCAGCGGTTCCGAGTCAGGTTCTGGTGGCGAACCTTCCGA GTCTGGTAGCTCAGGTGAATCTCCGGGTGGTTCTAGCGGTTCCG AGTCAGGTGAATCTCCGGGTGGTTCCAGCGGTTCTGAGTCAGGT TCCTCCGAAAGCGGTTCTTCTGAGGGCGGTCCAGGTTCCTCCGA AAGCGGTTCTTCCGAGGGCGGTCCAGGTTCTTCTGAAAGCGGTT CTTCCGAGGGCGGTCCAGGTGAATCTCCTGGTGGTTCCAGCGGT TCCGAGTCAGGTGAATCTCCAGGTGGCTCTAGCGGTTCCGAGTC AGGTGAATCTCCTGGTGTTCTAGCGGTTCTGAATCAGGTTCCT CCGAAAGCGGTTCTTCTGAGGGCGGTCCAGGTTCCTCCGAAAG CGGTTCTTCCGAGGGCGGTCCAGGTTCTTCTGAAAGCGGTTCTT CCGAGGGCGGTCCAGGTTCTTCTGAAAGCGGTTCTTCTGAGGG CGGTTCCAGGTTCTTCCGAAAGCGGTTCTTCCGAGGGCGGTCCAG GTTCTTCCGAAAGCGGTTCTTCTGAAAGCGGTCCAGGTTCTGGT GGCGAACCGTCCGAGTCTGGTAGCTCAGGTGAATCTCCGGGTG GCTCTAGCGGTTCCGAGTCAGGTGAATCTCCTGGTGGTTCCAGC GGTTCCGAGTCAGGTTCCGGTGGCGAACCGTCCGAATCTGGTA GCTCAGGTAGCGAAGGTTCTTCTGGTCCAGGCGAATCTTCAGGT TCCTCTGAAAGCGGTTCTTCTGAGGGCGGTCCAGGTTCCGGTGG CGAACCGTCCGAATCTGGTAGCTCAGGTAGCGAAGGTTCTTCTG GTCCAGGCGAATCTTCAGGTTCCTCTGAAAGCGGTTCTTCTGAG GGCGGTCCAGGTTCCGGTGGCGAACCTTCCGAATCTGGTAGCTC AGGTGAATCTCCGGGTGTTCTAGCGGTTCTGAGTCAGGTTCTG GTGGTGAACCTTCCGAGTCTGGTAGCTCAGGTTCTGGTGGCGAA CCATCCGAGTCTGGTAGCTCAGGTTCTTCCGAAAGCGGTTCTTC CGAAGGCGGTCCAGGTTCTGGTGGTGAACCGTCCGAATCTGGT AGCTCAGGTTCTGGTGGCGAACCATCCGAATCTGGTAGCTCAG GTAGCGAAGGTTCTTCTGGTCCTGGCGAATCTTCAGGTGAATCT CCAGGTGGCTCTAGCGGTTCCGAATCAGGTAGCGAAGGTTCTTC CGGTCCAGGTGAATCTTCAGGTAGCGAAGGTTCTTCTGGTCCTG GTGAATCCTCAGGTTCCGGTGGCGAACCATCTGAATCTGGTAGC TCAGGTTCCTCTGAAAGCGGTTCTTCCGAAGGTGGTCCAGGTTC CTCTGAAAGCGGTTCTTCTGAGGGTGGTCCAGGTGAATCTCCGG GTGGCTCCAGCGGTTCCGAGTCAGGTTCTGGTGGCGAACCATCC GAATCTGGTAGCTCAGGTAGCGAAGGTTCTTCTGGTCCTGGCGA ATCTTCAGGTGAATCTCCAGGTGGCTCTAGCGGTTCCGAATCAG GTAGCGAAGGTTCTTCCGGTCCAGGTGAATCTTCAGGTAGCGA AGGTTCTTCTGGTCCTGGTGAATCCTCAGGTTCCGGTGGCGAA CCATCTGAATCTGGTAGCTCAGGTTCTTGGTGGCGAACCATCGA ATCTGGTAGCTCAGGTGAATCTCCGGGTGGCTCCAGCGGTTCTG AATCAGGTGAATCTCCTGGTGGCTCCAGCGGTTCTGAGTCAGGT TCTGGTGGCGAACCATCCGAATCTGGTAGCTCAGGTAGCGAAG GTTCTTCTGGTCCTGGTGAATCTTCAGGTGAATCTCCAGGTGG TCTAGCGGTTCCGAATCAGGTTCCTCTGAAAGCGGTTCTTCTGA GGGCGGTCCAGGTTCTTCCGAAAGCGGTTCTTCCGAGGGCGGT CCAGGTTCTTCCGAAAGCGGTTCTTCTGAAGGCGGTCCAGGTTC TGGTGGCGAACCGTCCGAATCTGGTAGCTCAGGTTCCTCCGAA AGCGGTTCTTCTGAAGGTGAATCTCCAGGTTCCTCCGAA TAGCGGTTCTGAATCAGGTTCTTGGTGGCGAACCGTCCGAATCTG GTAGCTCAGGTTCCTCCGAAAGCGGTTCTTCTGAAGGTGGTCCA GGTGAATCTCCAGGTGGTTCTAGCGGTTCTGAATCAGGTTCTGG TGGCGAACCGTCCGAATCTGGTAGCTCAGGTGAATCTCCGGGT GTTCCAGCGGTTCCGAGTCAGGTTCTGGTGGCGAACCTTCCGAA TCTGGTAGCTCAGGTTTTCCGACTATTCCGCTGTCTCGTCTGTTT GATAATGCTATGCTGCGTGCGCACCGTCTGCACCAGCTGGCCTT TGATACTTACCAGGAATTTGAAGAAGCCTACATTCCTAAAGAGC AGAAGTACTCTTTCCTGCAAAACCCACAGACTTCTCTCTGCTTC AGCGAATCTATTCCGACGCCTTCCAATGCGAGGAAACTCAGC AAAAGTCCAATCTGGAACTACTCCGCATTTCTCTGCTTCTGATT CAGGACTGGCTGGAACCAGTGCAATTTCTGCGTTCCGTCTTCGC CAATAGCCTAGTTTATGGCGCATCCGACAGCAACGTATACGAT CTCCTGAAAGATCTCGAGGAAGGCATTCAGACCCTGATGGGTC GTCTCGAGGATGGCTCTCCGCGTACTGGTCAGATCTTCAAGCAG ACTTACTCTAAATTTGATACTAACAGCCACAATGACGATGCGCT TCTAAAAAACTATGGTCTGCTGTATTGTTTTCGTAAAGATATGG | 688 |

TABLE 35-continued

Exemplary GHXTEN comprising growth hormones and single XTEN

| GHXTEN Name* | Amino Acid Sequence | SEQ ID NO: | DNA Nucleotide Sequence | SEQ ID NO: |
|---|---|---|---|---|
| | | | ACAAAGTTGAAACCTTCCTGCGTATTGTTCAGTGTCGTTCCGTT GAGGGCAGCTGTGGTTTCTAA | |
| AE864-hGH | GSPAGSPTSTEEGTS ESATPESGPGTSTEPS EGSAPGSPAGSPTST EEGTSTEPSEGSAPG TSTEPSEGSAPGTSES ATPESGPGSEPATSG SETPGSEPATSGSETP GSPAGSPTSTEEGTS ESATPESGPGTSTEPS EGSAPGTSTEPSEGS APGSPAGSPTSTEEG TSTEPSEGSAPGTSTE PSEGSAPGTSESATP ESGPGTSTEPSEGSA PGTSESATPESGPGS EPATSGSETPGTSTEP SEGSAPGTSTEPSEG SAPGTSESATPESGP GTSESATPESGPGSP AGSPTSTEEGTSESA TPESGPGSEPATSGS ETPGTSESATPESGP GTSTEPSEGSAPGTS TEPSEGSAPGTSTEPS EGSAPGTSTEPSEGS APGTSTEPSEGSAPG TSTEPSEGSAPGSPA GSPTSTEEGTSTEPSE GSAPGTSESATPESG PGSEPATSGSETPGT SESATPESGPGSEPA TSGSETPGTSESATPE SGPGTSTEPSEGSAP GTSESATPESGPGSP AGSPTSTEEGSPAGS PTSTEEGSPAGSPTST EEGTSESATPESGPG TSTEPSEGSAPGTSES ATPESGPGSEPATSG SETPGTSESATPESGP GSEPATSGSETPGTS ESATPESGPGTSTEPS EGSAPGSPAGSPTST EEGTSESATPESGPG SEPATSGSETPGTSES ATPESGPGSPAGSPT STEEGSPAGSPTSTEE GTSTEPSEGSAPGTS ESATPESGPGTSESA TPESGPGTSESATPES GPGSEPATSGSETPG SEPATSGSETPGSPA GSPTSTEEGTSTEPSE GSAPGTSTEPSEGSA PGSEPATSGSETPGT SESATPESGPGTSTEP SEGSAPGFPTIPLSRL FDNAMLRAHRLHQL AFDTYQEFEEAYIPK EQKYSFLQNPQTSLC FSESIPTPSNREETQQ KSNLELLRISLLLIQS WLEPVQFLRSVFAN SLVYGASDSNVYDL LKDLEEGIQTLMGRL EDGSPRTGQIFKQTY SKFDTNSHNDDALL KNYGLLYCFRKDMD | 689 | GGTAGCCCGGCTGGCTCTCCTACCTCTACTGAGGAAGGTACTTC TGAAAGCGCTACTCCTGAGTCTGGTCCAGGTACCTCTACTGAAC CGTCCGAAGGTAGCGCTCCAGGTAGCCCAGCAGGCTCTCCGAC TTCCACTGAGGAAGGTACTTCTACTGAACCTTCCGAAGGCAGC GCACCAGGTACCTCTACTGAACCTTCTGAGGGCAGCGCTCCAG GTACTTCTGAAAGCGCTACCCCGGAATCTGGCCCAGGTAGCGA ACCGGCTACTTCTGGTTCTGAAACCCCAGGTAGCGAACCGGCT ACCTCCGGTTCTGAAACTCCAGGTAGCCCGGCAGGCTCTCCGAC CTCTACTGAGGAAGGTACTTCTGAAAGCGCAACCCCGGAGTCC GGCCCAGGTACCTCTACCGAACCGTCTGAGGGCAGCGCACCAG GTACTTCTACCGAACCGTCCGAGGGTAGCGCACCAGGTAGCCC AGCAGGTTCTCCTACCTCCACCGAGGAAGGTACTTCTACCGAAC CGTCCGAGGGTAGCGCACCAGGTACCTCTACTGAACCTTCTGA GGGCAGCGCTCCAGGTACTTCTGAAAGCGCTACCCCGGAGTCC GGTCCAGGTACTTCTGAAAGCGCTACCCCGGAGTCTGGTCCAG GTACTTCTGAAAGCGCAACCCCTGAATCCGGTCCAGGTAGCGA ACCGGCTACTTCTGGCTCTGAGACTCCAGGTACTTCTACCGAAC CGTCCGAAGGTAGCGCACCAGGTACTTCTACTGAACCGTCTGA AGGTAGCGCACCAGGTACTTCTGAAAGCGCAACCCCGGAATCC GGCCCAGGTACCTCTGAAAGCGCAACCCCGGAGTCCGGCCCAG GTAGCCCTGCTGCTCCAACCTCCACCGAAGAAGGTACCTCT GAAAGCGCAACCCCTGAATCCGGCCAGGTAGCGAACCGGCAA CCTCCGGTTCTGAAACCCCAGGTACCTCTGAAAGCGCTACTCCG GAGTCTGGCCCAGGTACCTCTACTGAACCGTCTGAGGGTAGCG CTCCAGGTACTTCTACTGAACCGTCCGAAGGTAGCGCACCAGG TACTTCTACCGAACCGTCCGAAGGCAGCGCTCCAGGTACCTCTA CTGAACCTTCCGAGGGCAGCGCTCCAGGTACCTCTACCGAACCT TCTGAAGGTAGCGCACCAGGTACTTCTACCGAACCGTCCGAGG GTAGCGCACCAGGTAGCCCAGCAGGTTCTCCTACCTCCACCGA GGAAGGTACTTCTACCGAACCGTCCGAGGGTAGCGCACCAGGT ACCTCTGAAAGCGCAACCCCTGAGTCTGGCCCAGGTAGCGAAC CTGCTACCTCCGGCTCTGAGACTCCAGGTACCTCTGAAAGCGCA ACCCCGGAATCTGGTCCAGGTAGCGAACCTGCAACCTCTGGCT CTGAAACCCCAGGTACCTCTGAAAGCGCTACTCCTGAATCTGGCC CAGGTACTTCTACTGAACCGTCCGAGGGCAGCGCACCAGGTAG CCCTGCTGGTCTCCAACCTCCACCGAAGAAGGTACCTCTGAAA GCGCAACCCCTGAATCCGGCCCAGGTAGCGAACCGGCAACCTC CGGTTCTGAAACCCCAGGTACTTCTGAAAGCGCTACTCCTGAGT CCGGCCCAGGTAGCCCGGCTGGCTCTCCGACTTCCACCGAGGA AGGTAGCCCGGCTGGCTCTCCAACTTCTACTGAAGAAGGTACTT CTACCGAACCTTCCGAGGGCAGCGCACCAGGTACTTCTGAAAG CGCTACCCCTGAGTCTGGCCCAGGTACTTCTGAAAGCGCTACTC CTGAATCCGGTCCAGGTACTTCTGAAAGCGCTACCCCGGAATCT GGCCCAGGTAGCGAACCGGCTACTTCTGGTTCTGAAACCCCAG GTAGCGAACCGGCTACCTCCGGTTCTGAAACTCCAGGTAGCCC AGCAGGCTCTCCGACTTCCACTGAGGAAGGTACTTCTACTGAAC CTTCCGAAGGCAGCGCACCAGGTACCTCTACTGAACCTTCTGAA GGCAGCGCTCCAGGTAGCGAACCTGCAACCTCTGGCTCTGAAA CCCCAGGTACCTCTGAAAGCGCTACTCCTGAATCTGGCCCAGGT ACTTCTACTGAACCGTCCGAGGGCAGCGCACCAGGTTTTCCGAC TATTCCGCTGTCTCGTCTGTTTGATAATGCTATGCTGCGTGCGC ACCGTCTGCACCAGCTGGCCTTTGATACTTACCAGGAATTTGAA GAAGCcTACATTCCTAAAGAGCAGAAGTACTCTTTCCTGCAAAA CCCACAGACTTCTCTCTGCTTCAGCGAATCTATTCCGACGCCTT CCAATCGCGAGGAAACTCAGCAAAAGTCCAATCTGGAACTACT CCGCATTTCTCTGCTTCTGATTCAGAGCTGGCTAGAACCAGTGC AATTTCTGCGTTCCGTCTTCGCCAATAGCCTAGTTTATGGCGCA TCCGACAGCAACGTATACGATCTCCTGAAAGATCTCGAGGAAG | 690 |

TABLE 35-continued

Exemplary GHXTEN comprising growth hormones and single XTEN

| GHXTEN Name* | Amino Acid Sequence | SEQ ID NO: | DNA Nucleotide Sequence | SEQ ID NO: |
|---|---|---|---|---|
| | KVETFLRIVQCRSVE GSCGF | | GCATTCAGACCCTGATGGGTCGTCTCGAGGATGGCTCTCCGCGT ACTGGTCAGATCTTCAAGCAGACTTACTCTAAATTTGATACTAA CAGCCACAATGACGATGCGCTTCTAAAAAAACTATGGTCTGCTGT ATTGTTTTCGTAAAGATATGGACAAAGTTGAAACCTTCCTGCGT ATTGTTCAGTGTCGTTCCGTTGAGGGCAGCTGTGGTTTCTAA | |
| AF864-hGH | GSTSESPSGTAPGTSP SGESSTAPGSTSESPS GTAPGSTSESPSGTA PGTSTPESGSASPGTS TPESGSASPGSTSESP SGTAPGSTSESPSGT APGTSPSGESSTAPG STSESPSGTAPGTSPS GESSTAPGTSPSGESS TAPGSTSSTAESPGP GTSPSGESSTAPGTSP SGESSTAPGSTSSTA ESPGPGTSTPESGSAS PGTSTPESGSASPGST SESPSGTAPGSTSESP SGTAPGSTSTPESGSA SPGSTSSTAESPGPGT STPESGSASPGSTSES PSGTAPGSTSPSGESST APGSTSSTAESPGPG TSPSGESSTAPGTSTP ESGSASPGSTSSTAES PGPGSTSSTAESPGP GSTSSTAESPGPGSTS STAESPGPGTSPSGES STAPGSTSESPSGTAP GSTSESPSGTAPGTS TPESGPXXXGASASG APSTXXXXSESPSGT APGSTSESPSGTAPG STSESPSGTAPGSTSE SPSGTAPGSTSESPSG TAPGSTSESPSGTAP GTSTPESGSASPGTSP SGESSTAPGTSPSGES STAPGSTSSTAESPGP GTSPSGESSTAPGTS TPESGSASPGSTSESP SGTAPGSTSESPSGT APGTSPSGESSTAPG STSESPSGTAPGTSTP ESGSASPGSTSTPESGS ASPGSTSESPSGTAP GTSTPESGSASPGSTS STAESPGPGTSESPS GTAPGSTSESPSGTA PGTSPSGESSTAPGST SSTAESPGPGTSPSGE SSTAPGSTSTPESGSAS PGTSPSGESSTAPGTS PSGESSTAPGTSPSGE SSTAPGSTSSTAESPG PGSTSSTAESPGPGTS PSGESSTAPGSSPSAS TGTGPGSSTPSGATG SPGSSTPSGATGSPG FPTIPLSRLFDNAML RAHRLHQLAFDTYQ EFEEAYIPKEQKYSF LQNPQTSLCFSESIPT PSNREETQQKSNLEL LRISLLLIQSWLEPVQ FLRSVFANSLVYGAS DSNVYDLLKDLEEGI QTLMGRLEDGSPRT GQIFKQTYSKFDTNS HNDDALLKNYGLLY CFRKDMDKVETFLRI VQCRSVEGSCGF | 691 | GGTTCTACCAGCGAATCTCCTTCTGGCACCGCTCCAGGTACCTC TCCTAGCGGCGAATCTTCTACCGCTCCAGGTTCTACTAGCGAAT CTCCTTCTGGCACTGCACCAGGTTCTACTAGCGAATCCCCGTCT GGTACTGCTCCAGGTACTTCTACTCCTGAAAGCGGTTCCGCTTC TCCAGGTACCTCTACTCCGGAAAGCGGTTCTGCATCTCCAGGTT CTACCAGCGAATCTCCTTCTGGCACCGCTCCAGGTTCTACTAGC GAATCCCGTCTGGTACCGCACCAGGTACTTCTCCTAGCGGCGA ATCTTCTACCGCACCAGGTTCTACTAGCGAATCTCCGTCTGGCA CTGCTCCAGGTACTTCTCCTAGCGGTGAATCTTCTACCGCTCCA GGTACTTCCCTAGCGGCGAATCTTCTACCGCTCCAGGTTCTAC TAGCTCTACTGCAGAATCTCCGGGCCCAGGTACCTCTCCTAGCG GTGAATCTTCTACCGCTCCAGGTACTTCTCCGAGCGGTGAATCT TCTACCGCTCCAGGTTCTACTAGCTCTACTGCAGAATCTCCTGG CCCAGGTACCTCTACTCCGGAAAGCGGCTCTGCATCTCCAGGTA CTTCTACCCCTGAAAGCGGTTCTGCATCTCCAGGTTCTACTAGC GAATCTCCTTCTGGCACTGCACCAGGTTCTACCAGCGAATCTCC GTCTGGCACTGCACCAGGTACCTCTACCCCTGAAAGCGGTTCCG CTTCTCCAGGTTCTACCGCAGAATCTCCTGGTCCA GGTACCTCTACTCCTGAAAGCGGTTCTGCATCTCCAGGTT CCACTAGCTCTACCGCAGAATCTCCGGGCCCAGGTTCTACTAGC TCTACTGCTGAATCTCCTGGCCCAGGTTCTACTAGCTCTACTGC TGAATCTCCAGGTTCTACCAGCTCTACTGCTGAATCTC CTGGTCCAGGTACTCCCCGAGCGGTGAATCTTCTACTGCACCA GGTTCTACTAGCGAATCTCCTTCTGGCACTGCACCAGGTTCTAC CAGCGAATCTCCGTCTGGCACTGCACCAGGTACCTCTACCCCTG AAAGCGGTCCXXXXXXXXXXXXTGCAAGCGCAAGCGGCGCGC CAAGCACGGGAXXXXXXXXTAGCGAATCATCTTTCTGGTACTGC TCCAGGTTCTACCAGCGAATCCCCGTCTGGTACTGCTCCAGGTT CTACCAGCGAATCTCCTTCTGGTACTGCACCAGGTTCTACTAGC GAATCTCCTTCTGGTACCGCTCCAGGTTCTACCAGCGAATCCCC GTCTGGTACTGCTCCAGGTTCTACCAGCGAATCTCCTTCTGGTA CTGCACCAGGTACTTCTACTCCGGAAAGCGGTTCCGCATCTCCA GGTACTTCTCCTAGCGGTGAATCTTCTACTGCTCCAGGTACCTC TCCTAGCGGCGAATCTTCTACTGCTCCAGGTTCTACCAGCTCTA CTGCTGAATCTCCTGGTCCCAGGTACTTCCCCGAGCGGTGAATCT TCTACTGCACCAGGTACTTCTACTCCGGAAAGCGGTTCCGCTTC TCCAGGTTCTACCAGCGAATCTCCTTCTGGCACCGCTCCAGGTT CTACTAGCGAATCCCGTCTGGTACCGCACCAGGTACTTCTCCT AGCGGCGAATCTTCTACCGCGAATCCCCGTCTGGTACCGCACCA GGTTCTACCAGCGAATCTCCTTCTGGTACCGCACCAGGTACTTC TACCCCTGAAAGCGGCTCCGCTTCTCCAGGTTCCACTAGCTCTA CTGCTGAATCTCCGGGTCCAGGTTCTACCAGCGAATCTCCTTCT GGCACCGCTCCAGGTTCTACTAGCGAATCCCCGTCTGGTACCGC ACCAGGTACTTCTCCTAGCGGCGAATCTTCTACCGCACCAGGTT CTACCAGCTCTACTGCTGAATCTCCGGGTCCAGGTACTTCCCCG AGCGGTGAATCTTCTACTGCACCAGGTACTTCTACTCCGGAAAG CGGTTCCGCTTCTCCAGGTACCTCCCCTAGCGGCGAATCTTCTA CTGCTCCAGGTACCTCTCCTAGCGGCGAATCTTCTACCGCTCCA GGTACCTCCCCTAGCGGTGAATCTTCTACCGCACCAGGTTCTAC TAGCTCTACTGCTGAATCTCCTGGTTCTACCAGCTCTA CCGCTGAATCTCCTGGTCCAGGTACCTCCCCGAGCGGTGAATCT CTACTGCACCAGGTTCTAGCCCTTCTGCTTCCACCGGTACCGG CCCAGGTAGCTCTACTCCGTCTGGTGCAACTGGCTCTCCAGGTA GCTCTACTCCGTCTGGCAACCGGCTCCCCAGGTTTTCCAGACT ATTCCGCTGTCTCGTCTGTTTGATAATGCTATGCTGCGTGCGCA CCGTCTGCACCAGCTGGCCTTTGATACTTACCAGGAATTTGAAG AAGCCTACATTCCTAAAGAGCAGAAGTACTCTTTCCTGCAAAAC CCACAGACTTCTCTGTGCTTCAGCGAATCTATTCCGACGCCTTC CAATCGCGAGGAAACTCAGCAAAAGTCAATCTGGAACTACTC CGCATTTCTGCTTCTGATTCAGAGCTGGCTAGAACCAGTGCA ATTTCTGCGTTCCGTCTTCGCCAATAGCCTAGTTATGGCGCAT CCGACAGCAACGTATACGATCTCCTGAAAGATCTCGAGGAAGG CATTCAGACCCTGATGGGTCGTCTCGAGGATGGCTCTCCGCGTA | 692 |

TABLE 35-continued

Exemplary GHXTEN comprising growth hormones and single XTEN

| GHXTEN Name* | Amino Acid Sequence | SEQ ID NO: | DNA Nucleotide Sequence | SEQ ID NO: |
|---|---|---|---|---|
| | | | CTGGTCAGATCTTCAAGCAGACTTACTCTAAATTTGATACTAAC<br>AGCCACAATGACGATGCGCTTCTAAAAAACTATGGTCTGCTGT<br>ATTGTTTTCGTAAAGATATGGACAAAGTTGAAACCTTCCTGCGT<br>ATTGTTCAGTGTCGTTCCGTTGAGGGCAGCTGTGGTTTCTAA | |
| AG864-hGH | GASPGTSSTGSPGSS PSASTGTGPGSSPSA STGTGPGTPGSGTAS SSPGSSTPSGATGSP GSNPSASTGTGPGAS PGTSSTGSPGTPGSG TASSSPGSSTPSGAT GSPGTPGSGTASSSP GASPGTSSTGSPGAS PGTSSTGSPGTPGSG TASSSPGSSTPSGAT GSPGASPGTSSTGSP GTPGSGTASSSPGSS TPSGATGSPGSNPSA STGTGPGSSPSASTG TGPGSSTPSGATGSP GSSTPGATGSPGAS PGTSSTGSPGASPGT SSTGSPGASPGTSST GSPGTPGSGTASSSP GASPGTSSTGSPGAS PGTSSTGSPGASPGT SSTGSPGSSPSASTGT GPGTPGSGTASSSPG ASPGTSSTGSPGASP GTSSTGSPGASPGTS STGSPGSSTPSGATG SPGSSTPSGATGSPG ASPGTSSTGSPGTPG SGTASSSPGSSTPSG ATGSPGSSTPSGATG SPGSSTPSGATGSPG SSPSASTGTGPGASP GTSSTGSPGASPGTS STGSPGTPGSGTASS SPGASPGTSSTGSPG ASPGTSSTGSPGASP GTSSTGSPGASPGTS STGSPGTPGSGTASS SPGSSTPSGATGSPG TPGSGTASSSPGSSTP SGATGSPGTPGSGTA SSSPGSSTPSGATGSP GSSTPSGATGSPGSS PSASTGTGPGSSPSA STGTGPGASPGTSST GSPGTPGSGTASSSP GSSTPSGATGSPGSS PSASTGTGPGSSPSA STGTGPGASPGTSST GSPGASPGTSSTGSP GSSTPSGATGSPGSS PSASTGTGPGASPGT SSTGSPGSSPSASTGT GPGTPGSGTASSSPG SSTPSGATGSPGSSTP SGATGSPGASPGTSS TGSPGFPTIPLSRLFD NAMLRAHRLHQLAF DTYQEFEEAYIPKEQ KYSFLQNPQTSLCFS ESIPTPSNREETQQKS NLELLRISLLLIQSWL EPVQFLRSVFANSLV YGASDSNVYDLLKD LEEGIQTLMGRLEDG SPRTGQIFKQTYSKF DTNSHNDDALLKNY GLLYCFRKDMDKVE | 693 | GGTGCTTCCCCGGGCACCAGCTCTACTGGTTCTCCAGGTTCTAG CCCGTCTGCTTCTACTGGTACTGGTCCAGGTTCTAGCCCTTCTGC TTCCACTGGTACTGGTCCAGGTACCCCGGGTAGCGGTACCGCTT CTTCTTCTCCAGGTAGCTCTACTCCGTCTGGTGCTACCGGCTCTC CAGGTTCTAACCCTTCTGCATCCACCGGTACCGGCCCAGGTGCT TCTCCGGGCACCAGCTCTACTGGTTCTCCAGGTACCCCGGGCAG CGGTACCGCATCTTCTTCTCCAGGTAGCTCTACTCCTTCTGGTGC AACTGGTTCTCCAGGTACTCCTGGCAGCGGTACCGCTTCTTCTT CTCCAGGTGCTTCTCCTGGTACTAGCTCTACTGGTTCTCCAGGT GCTTCTCCGGGCACTAGCTCTACTGGTTCTCCAGGTACCCCGGG TAGCGGTACTGCTTCTTCCTCTCCAGGTAGCTCTACCCCTTCTGG TGCAACCGGCTCTCCAGGTGCTTCTCCGGGCACCAGCTCTACCG GTTCTCCAGGTACCCCGGGTAGCGGTACCGCTTCTTCTTCTCCA GGTAGCTCTACTCCGTCTGGTGCTACCGGCTCTCCAGGTTCTAA CCCTTCTGCATCCACCGGTACCGGCCCAGGTTCTAGCCCTTCTG CTTCCACCGGTACTGGCCCAGGTAGCTCTACCCCTTCTGGTGCT ACCGGCTCCCCAGGTAGCTCTACTCCTTCTGGTGCAACTGGCTC TCCAGGTGCATCTCCGGGCACTAGCTCTACTGGTTCTCCAGGTG CATCCCCTGGCACTAGCTCTACTGGTTCTCCAGGTGCTTCTCCG GGTACCAGCTCTACTGGTTCTCCAGGTACTCCTGGCAGCGGTAC CGCTTCTTCTTCTCCAGGTGCTTCTCCTGGTACTAGCTCTACTGG TTCTCCAGGTGCTTCTCCGGGCACTAGCTCTACTGGTTCTCCAG GTGCTTCCCCGGGCACTAGCTCTACCGGTTCTCCAGGTTCTAGC CCTTCTGCATCTACTGGTACTGGCCCAGGTACTCCGGGCAGCGG ASPGTSSTGSPGASP TACTGCTTCTTCCTCTCCAGGTGCATCTCCGGGCACTAGCTCTA CTGGTTCTCCAGGTGCATCCCCTGGCACTAGCTCTACTGGTTCT CCAGGTGCTTCTCCTGGTACCAGCTCTACTGGTTCTCCAGGTAG CTCTACTCCGTCTGGTGCAACGGTTCCCCAGGTAGCTCTACTCC TCCGTGTGCTACTGGCTCTCCAGGTAGCTCTACTC CTTCTGGTGCTACTGGCTCCCCAGGTGCATCCCCTGGCACCAGC TCTACCGGTTCTCCAGGTACCCCGGGCAGCGGTACCGCATCTTC CTCTCCAGGTAGCTCTACCCCGTCTGGTGCTACCGGTTCCCCAG GTAGCTCTACCCCGTCTGGTGCTACCGGTTCCCCAG GTAGCTACCCCGTCTGGTGCAACCGGCTCCCCAGGTAGCTCT ACTCCGTCTGGTGCAACCGGCTCCCCAGGTTCTAGCCCCGTCTGC TTCCACTGGTACTGGCCCAGGTGCTTCCCCGGGCACCAGCTCTA CTGGTTCTCCAGGTGCATCCCCGGGTACCAGCTCTACCGGTTCT CCAGGTACTCCTGGCAGCGGTACTGCATCTTCCTCTCCAGGTTCT TCTACTCCGTCTGGTGCTACCGGTTCTCCAGGTGCTTCTCCTGGTACCAGCTCTACTGGT TCTCCAGGTACCCCGGGTAGCGGTACCGCTTCTTCCTCTCCAGG TAGCTCTACTCCGTCTGGTGCTACCGGTTCTCCAGGTACCCCGG GTAGCGGTACCGCATCTTCTTCTCCAGGTAGCTCTACCCCGTCT GGTGCTACTGGTTCTCCAGGTACTCCGGGCAGCGGTACTGCTTC TTCCTCTCCAGGTAGCTCTACCCCGTCTGGTGCTACTGGCTCCCCAGGTTCTA GCCCTTCTGCATCCACCGGTACCGGTCAGGTTCTAGCCCCGTCT GCATCTACTGGTACTGGTCCAGGTGCATCCCCGGGCACTAGCTC TACCGGTTCTCCAGGTACTGGTCCAGGTAGCGGTACTGCTTCTTC TCCAGGTAGCTCTACTCCTTCTGGTGCTACTGGTTCTCCAGGTTC TAGCCCCTTCTGCATCCACCGGTACCGGCCCAGGTTCTAGCCCCGT CTGCTTCTACCGGTACTGGTCCAGGTGCTTCTCCGGGTACTAGC TCTACTGGTTCTCCAGGTGCATCTCCTGGTACTAGCTCTACTGG TTCTCCAGGTAGCTCTACTCCGTCTGGTGCAACCGGCTCTCCAG GTTCTAGCCCCTTCTGCATCTACCGGTACTGGTCCAGGTGCATCC CCTGGTACCAGCTCTACCGGTTCTCCAGGTTCTAGCCCCTTCTGC TTCTACCGGTACCGGTCAGGTACCCCTGGCAGCGGTACCGCAT CTTCCTCTCCAGGTAGCTCTACTCCGTCTGGTGCAACCGGTTCC CCAGGTAGCTCTACTCCTTCTGGTGCTACTGGCTCCCCAGGTGC ATCCCCTGGCACCAGCTCTACCGGTTCTCCAGGTTTTCCGACTA TTCCGCTGTCTCGTCTGTTTGATAATGCTATGCTGCGTGCGCAC CGTCTGCACCAGCTGGCCTTTGATACTTACCAGGAATTTGAAGA AGCcTACATTCCTAAAGAGCAGAAGTACTCTTTCCTGCAAAACC CACAGACTTCTCTGCTTCGCAGTATTCCGACGCCTT AATCGCGAGGAAACTCAGCAAAGTCCAATCTGGAACTACTCC GCATTTCTCTGCTTCTGATTCAGAGCTGGCTAGAACCAGTGCAA TTTCTGCGTTCCGTCTTCGCCAATAGCCTAGTTTATGCGCATCC GACAGCAACGTATACGATCTCCTGAAAGATCTCGAGGAAGGCA TTCAGACCCTGATGGGTCGTCTCGAGGATGGCTCTCCGCGTACT GGTCAGATCTTCAAGCAGACTTACTCTAAATTTGATACTAACAG | 694 |

TABLE 35-continued

Exemplary GHXTEN comprising growth hormones and single XTEN

| GHXTEN Name* | Amino Acid Sequence | SEQ ID NO: | DNA Nucleotide Sequence | SEQ ID NO: |
|---|---|---|---|---|
| | TFLRIVQCRSVEGSC GF | | CCACAATGACGATGCGCTTCTAAAAAACTATGGTCTGCTGTATT GTTTTCGTAAAGATATGGACAAAGTTGAAACCTTCCTGCGTATT GTTCAGTGTCGTTCCGTTGAGGGCAGCTGTGGTTTCTAA | |
| AM875-hGH | GTSTEPSEGSAPGSE PATSGSETPGSPAGS PTSTEEGSTSSTAESP GPGTSTPESGSASPG STSESPSGTAPGSTSE SPSGTAPGSTPESGS ASPGTSTPESGSASP GSEPATSGSETPGTS ESATPESGPGSPAGS PTSTEEGTSTEPSEGS APGTSESATPESGPG TSTEPSEGSAPGTSTE PSEGSAPGSPAGSPT STEEGTSTEPSEGSAP GTSTEPSEGSAPGTS ESATPESGPGTSESA TPESGPGTSTEPSEGS APGTSTEPSEGSAPG TSESATPESGPGTSTE PSEGSAPGSEPATSG SETPGSPAGSPTSTEE GSSTPSGATGSPGTP GSGTASSSPGSSTPS GATGSPGTSTEPSEG SAPGTSTEPSEGSAP GSEPATSGSETPGSP AGSPTSTEEGSPAGS PTSTEEGTSTEPSEGS APGASASGAPSTGGT SESATPESGPGSPAG SPTSTEEGSPAGSPTS TEEGSTSSTAESPGP GSTSESPSGTAPGTSP SGESSTAPGTPGSGT ASSSPGSSTPSGATG SPGSSPSASTGTGPG SEPATSGSETPGTSES ATPESGPGSEPATSG SETPGSTSSTAESPGP GSTSSTAESPGPGTSP SGESSTAPGSEPATS GSETPGSEPATSGSE TPGTSTEPSEGSAPG STSSTAESPGPGTSTP ESGSASPGSTSESPSG TAPGTSTEPSEGSAP GTSTEPSEGSAPGTS TEPSEGSAPGSSTPSG ATGSPGSSPSASTGT GPGASPGTSSTGSPG SEPATSGSETPGTSES ATPESGPGSPAGSPT STEEGSSTPSGATGS PGSSPSASTGTGPGA SPGTSSTGSPGTSESA TPESGPGTSTEPSEGS APGTSTEPSEGSAPG FPTIPLSRLFDNAML RAHRLHQLAFDTYQ EFEEAYIPKEQKYSF LQNPQTSLCFSESIPT PSNREETQQKSNLEL LRISLLLIQSWLEPVQ FLRSVFANSLVYGAS DSNVYDLLKDLEEGI QTLMRLEDGSPRT GQIFKQTYSKFDTNS HNDDALLKNYGLLY CFRKDMDKVETFLRI VQCRSVEGSCGF | 695 | GGTACTTCTACTGAACCGTCTGAAGGCAGCGCACCAGGTAGCG AACCGGCTACTTCCGGTTCTGAAACCCCAGGTAGCCCAGCAGG TTCTCCAACTTCTACTGAAGAAGGTTCTACCAGCTCTACCGCAG AATCTCCTGGTCCAGGTACCTCTACTCCGGAAAGCGGCTCTGCA TCTCCAGGTTCTACTAGCGAATCTCCTTCTGGCACTGCACCAGG TTCTACTAGCGAATCCCCGTCTGGTACTGCTCCAGGTACTTCTA CTCCTGAAAGCGGTTCCGCTTCTCCAGGTACCTCTACTCCGGAA AGCGGTTCTGCATCTCCAGGTAGCGAACCGGCAACCTCCGGTT CTGAAACCCCAGGTACCTCTGAAAGCGCTACTCCTGAATCCGG CCCAGGTAGCCCGGCAGGTTCTCCGACTTCCACTGAGGAAGGT ACCTCTACTGAACCTTCTGAGGGCAGCGCTCCAGGTACTTCTGA AAGCGCTACCCCCGAGTCCGGCCCAGGTACTTCTGAAAGCGCTA CCGAAGGTAGCGCACCAGGTACTTCTACCGAACCGTCCGAGGG TAGCGCACCAGGTAGCCCAGCAGGTTCTCCTACCTCCACCGAG GAAGGTACTTCTACCGAACCGTCCGAGGGTAGCGCACCAGGTA CTTCTACCGAACCTTCCGGCAGCGCACCAGGTACTTCTGAA AGCGCTACCCCTGAGTCCGGCCCAGGTACTTCTGAAAGCGCTA CCTGAATCCGGTCCAGGTACCTCTACTGAACCTTCCGAAGGC AGCGCTCCAGGTACCTCTACCGAACCGTCCGAGGGCAGCGCAC CAGGTACTTCTGAAAGCGCAACCCCTGAATCCGGTCCAGGTAC TTCTACTGAACCTTCCGAAGGTAGCGCTCCAGGTAGCGAACCTG CTACTTCTGGTTCTGAAACCCCAGGTAGCCCGGCTGGCTCTCCG ACCTCCACCGAGGAAGGTAGCTCTACCCCGTCTGGTGCTACTGG TTCTCCAGGTACTCCGGGCAGCGGTACTGCTTCTTCCTCTCCAG GTAGCTCTACCCCTTCTGGTGCTACTGGCTCTCCAGGTACCTCT ACCGAACCGTCCGAGGGTAGCGCACCAGGTACCTCTACTGAAC CGTCTGAGGGTAGCGCTCCAGGTAGCGAACCGGCAACCTCCGG TTCTGAAACTCCAGGTAGCCCTGCTGGCTCTCCGACTTCTACTG AGGAAGGTAGCCCGGCTGGTTCTCCGACTTCTACTGAAGGTT TACTTCTACCGAACCTTCCGAAGGTAGCGCTCCAGGTGCAAGC GCAAGCGGCGCGCCAAGCACGGGAGGTACTTCTGAAAGCGCTA CCTCCTGAGTCCGGCCCAGGTAGCCCGGCTGGCTCTCCGACTTCC ACCGAGGAAGGTAGCTCTACCGCTGAATCCTGGCCCAGGTTCT ACTAGCGAATCTCCGTCTGGCACCGCACCAGGTACTTCCCCTAG CGGTGAATCTTCTACTGCACCAGGTACCCCTGGCAGCGGTACCG CTTCTTCCTCTCCAGGTAGCTCTACCCCGTCTGGTGCTACTGGCT CTCCAGGTTCTAGCCCGTCTGCATCTACCGGTACCGGCCCAGGT AGCGAACCGGCAACCTCCGGTCTGAAACTCCAGGTACTTCTG AAAGCGCTACTCCGGAATCCGGCCCAGGTAGCGAACCGGCTAC TTCCGGCTCTGAAACCCCAGGTTCCACCAGCTCTACTGCAGAAT CTCCGGGCCCAGGTTCTACTAGCTCTACTGCAGAATCTCCGGGT CCAGGTACTTCTCCTAGCGGCGAATCTTCTACCGCTCCAGGTAG CGAACCGGCAACCTCCGGCTCTGAAACTCCAGGTAGCGAACCT GCAACCTCCGGCTCTGAAACCCCAGGTACTTCTACTGAACCTTC TGAGGGCAGCGCACCAGGTTCTACCAGCTCTACCGCAGAATCT CCTGGTCCAGGTACCTCTACTCCGGAAAGCGGCTCTGCATCTCC AGGTTCTACTAGCGAATCTCCTTCTGGCACTGCACCAGGTACTT CTACCGAACCGTCCGAAGGCAGCGCTCCAGGTACCTCTACCGA ACCTTCCGAGGGCAGCGCTCCAGGTACCTCTACCGAACCTTCTG AAGGTAGCGCACCAGGTAGCTCTACTCCGTCTGGTGCAACCGG CTCCCCAGGTTCTAGCCCGTCTGCTTCCACTGGTACTGGCCCAG GTGCTTCCCCGGGCACCAGCTCTACTGGTTCTCCAGGTAGCGAA CCTGCTACCTCCGGTTCTGAAACCCCAGGTACCTCTGAAAGCGC AACTCCGGAGTCTGGTCCAGGTAGCCCTGCAGGTTCTCCTACCT CCACTGAGGAAGGTAGCTCTACTCCGTCTGGTGCAACCGGCTCC CCAGGTTCTAGCCCGTCTGCTTCCACTGGTACTGGCCCAGGTGC TTCCCCGGGCACCAGCTCTACTGGTTCTCCAGGTACCTCTGAAA GCGCTACTCCGGAGTCTGGCCCAGGTACCTCTACTGAACCGTCT GAGGGTAGCGCTCCAGGTACTTCTACTGAACCGTCCGAAGGTA GCGCACCAGGTTTTCCGACTATTCCGCTGTCTCGTCTGTTTGAT AATGCTATGCTGCGTGCGCACCGTCTGCACCAGCTGGCCTTTGA TACTTACCAGGAATTTGAAGAAGCCTACATTCCTAAAGAGCAGA AGTACTCTTTCCTGCAAAACCCACAGACTTCTCTGTGCTTCAGC GAATCTATTCCGACGCCTTCCAATCGCGAGGAAACTCAGCAAA AGTCCAATCTGGAACTACTCCGCATTTCTCTGCTTCTGATTCAG AGCTGGAGAACAGTGCAATTTCTGCGTTCCGTCTTCGCCAA TAGCCTAGTTTATGGCGCATCCGACAGCAACGTATACGATCTCC TGAAAGATCTCGAGGAAGGCATTCAGACCCTGATGGGTCGTCT CGAGGATGGCTCTCCGCGTACTGGTCAGATCTTCAAGCAGACTT ACTCTAAATTTGATACTAACAGCCACAATGACGATGCGCTTCTA | 696 |

TABLE 35-continued

Exemplary GHXTEN comprising growth hormones and single XTEN

| GHXTEN Name* | Amino Acid Sequence | SEQ ID NO: | DNA Nucleotide Sequence | SEQ ID NO: |
|---|---|---|---|---|
| | | | AAAAACTATGGTCTGCTGTATTGTTTTCGTAAAGATATGGACAA AGTTGAAACCTTCCTGCGTATTGTTCAGTGTCGTTCCGTTGAGG GCAGCTGTGGTTTCTAA | |
| AE912-hGH | MAEPAGSPTSTEEGT PGSGTASSSPGSSTPS GATGSPGASPGTSST GSPGSPAGSPTSTEE GTSESATPESGPGTS TEPSEGSAPGSPAGS PTSTEEGTSTEPSEGS APGTSTEPSEGSAPG TSESATPESGPGSEP ATSGSETPGSEPATS GSETPGSPAGSPTST EEGTSESATPESGPG TSTEPSEGSAPGTSTE PSEGSAPGSPAGSPT STEEGTSTEPSEGSAP GTSTEPSEGSAPGTS ESATPESGPGTSTEPS EGSAPGTSESATPES GPGSEPATSGSETPG TSTEPSEGSAPGTSTE PSEGSAPGTSESATP ESGPGTSESATPESG PGSPAGSPTSTEEGT SESATPESGPGSEPA TSGSETPGTSESATPE SGPGTSTEPSEGSAP GTSTEPSEGSAPGTS TEPSEGSAPGTSTEPS EGSAPGTSTEPSEGS APGTSTEPSEGSAPG SPAGSPTSTEEGTSTE PSEGSAPGTSESATP ESGPGSEPATSGSET PGTSESATPESGPGS EPATSGSETPGTSES ATPESGPGTSTEPSE GSAPGTSESATPESG PGSPAGSPTSTEEGSP AGSPTSTEEGSPAGS PTSTEEGTSESATPES GPGTSTEPSEGSAPG TSESATPESGPGSEP ATSGSETPGTSESAT PESGPGSEPATSGSE TPGTSESATPESGPG TSTEPSEGSAPGSPA GSPTSTEEGTSESATP ESGPGSEPATSGSET PGTSESATPESGPGSP AGSPTSTEEGSPAGS PTSTEEGTSTEPSEGS APGTSESATPESGPG TSESATPESGPGTSES ATPESGPSEPATSG SETPGSEPATSGSETP GSPAGSPTSTEEGTS TEPSEGSAPGTSTEPS EGSAPGSEPATSGSE TPGTSESATPESGPG TSTEPSEGSAPGFPTI PLSRLFDNAMLRAH RLHQLAFDTYQEFEE AYIPKEQKYSFLQNP QTSLCFSESIPTPSNR EETQQKSNLELLRIS LLLIQSWLEPVQFLR SVFANSLVYGASDS NVYDLLKDLEEGIQT LMGRLEDGSPRTGQI FKQTYSKFDTNSHN DDALLKNYGLLYCF | 697 | ATGGCTGAACCTGCTGGCTCTCCAACCTCCACTGAGGAAGGTA CCCCGGGTAGCGGTACTGCTTCTTCCTCTCCAGGTAGCTCTACC CCTTCTGGTGCAACCGGCTCTCCAGGTGCTTCTCCGGGCACCAG CTCTACCGGTTCTCCAGGTAGCCCGGCTGGCTCTCCTACCTCTA CTGAGGAAGGTACTTCTGAAAGCGCTACTCCTGAGTCTGGTCCA GGTACCTCTACTGAACCGTCCGAAGGTAGCGCTCCAGGTAGCC CAGCAGGCTCTCCGACTTCCACTGAGGAAGGTACTTCTACTGAA CCTTCCGAAGGCAGCGCACCAGGTACCTCTACTGAACCTTCTGA GGGCAGCGCTCCAGGTACTTCTGAAAGCGCTACCCCGGAATCT GGCCCAGGTAGCGAACCGGCTACTTCTGGTTCTGAAACCCCAG GTAGCGAACCGGCTACCTCCGGTTCTGAAACTCCAGGTAGCCCC GGCAGGCTCTCCGACCTCTACTGAGGAAGGTACTTCTGAAAGC GCAACCCCGGAGTCCGGCCCAGGTACCTCTACCGAACCGTCTG AGGGCAGCGCACCAGGTACTTCTACCGAACCGTCCGAGGGTAG CGCACCAGGTAGCCCAGCAGGTTCTCCTACCTCCACCGAGGAA GGTACTTCTACCGAACCGTCCGAGGGTAGCGCACCAGGTACCT CTACTGAACCTTCTGAGGGCAGCGCTCCAGGTACTTCTGAAAGC GCTACCCCGGAGTCCGGTCCAGGTACTTCTACTGAACCGTCCGA AGGTAGCGCACCAGGTACTTCTGAAAGCGCAACCCCTGAATCC GGTCCAGGTAGCGAACCTGCTACTTCTGGTCTCTGAGACTCCAG GTACTTCTACCGAACCGTCCGAAGGTAGCGCACCAGGTACTTCT ACTGAACCGTCTGAAGGTAGCGCACCAGGTACTTCTGAAAGCG CAACCCCGGAATCCGGCCCAGGTACCTCTGAAAGCGCAACCCC GGAGTCCGGCCCAGGTAGCCCTGCTGGCTCTCCAACCTCCACCG AAGAAGGTACCTCTGAAAGCGCAACCCCTGAATCCGGCCCAGG TAGCGAACCGGCAACCTCCGGTTCTGAAACCCCAGGTACCTCT GAAAGCGCTACTCCGGAGTCTGGCCCAGGTACCTCTACTGAAC CGTCTGAGGGTAGCGCTCCAGGTACTTCTACTGAACCGTCCGAA GGTAGCGCACCAGGTACTTCTACCGAACCGTCCGAAGGCAGCG CTCCAGGTACCTCTACTGAACCTTCCGAGGGCAGCGCTCCAGGT ACCTCTACCGAACCTTCTGAAGGTAGCGCACCAGGTACTTCTAC CGAACCGTCCGAGGGTAGCGCACCAGGTAGCCCAGCAGGTTCT CCTACCTCCACCGAGGAAGGTACTTCTACCGAACCGTCCGAGGC GTAGCGCACCAGGTACCTCTGAAAGCGCAACCTCCTGAGTCTGG CCCAGGTAGCGAACCTGCTACCTCCGGCTCTGAGACTCCAGGT ACCTCTGAAAGCGCAACCCCGGAATCTGGTCCAGGTAGCGAAC CTGCAACCTCTGGCTCTGAAACCCCAGGTACCTCTGAAAGCGCT ACTCCTGAATCTGGCCCAGGTACTTCTACTGAACCGTCCGAGGG CAGCGCACCAGGTACTTCTGAAAGCGCTACTCCTGAGTCCGGC CCAGGTAGCCCGGCTGGCTCTC CGACTTCCACCGAGGAAGGTA GCCCGGCTGCTCTCCAACTTCTACTGAAGAAGGTAGCCCGGC AGGCTCTCCGACCTCTACTGAGGAAGGTACTTCTGAAAGCGCA ACCCCGGAGTCCGGCCCAGGTAGCCCGGCTGGCTCTCCAACTTCT ACTGAAGAAGGTACTTCTACCGAACCGTCCGAGGGCAGCGCAC CAGGTACTTCTGAAAGCGCTACCCCTGAGTCCGGCCCAGGTACT TCTGAAAGCGCTACTCCTGAATCCGGTCCAGGTACTTCTGAAAG CGCTACCCCGGAATCTGGCCCAGGTAGCGAACCGGCTACTTCT GGTTCTGAAACCCCGGAACCGGCTACCTCCGGTTCTG AAACTCCAGGTAGCCCAGCAGGCTCTCCGACTTCCACTGAGGA AGGTACTTCTACTGAACCTTCCGAAGGCAGCGCACCAGGTACC TCTACTGAACCTTCTGAGGGCAGCGCTCCAGGTAGCGAACCTG CAACCTCTGGCTCTGAAACCCCAGGTACCTCTGAAAGCGCTACT CCTGAATCTGGCCCAGGTACTTCTACTGAACCGTCCGAGGGCA GCGCACCAGGTTTTCCGACTATTCCGCTGTCTCGTCTGTTTGAT AATGCTATGCTGCGTGCGCACCGTCTGCACCAGCTGGCCTTTGA TACTTACCAGGAATTTGAAGAAGCAAGTACATTCCTAAAGAGCAGA AGTACTCTTCCTGCAAACCCACAGACTTCTCTGCTTCAGC GAATCTATTCCGACGCCTTCCAATCGCGAGGAAACTCAGCAAA GTCCAATCTGGAACTACTCCGCATTTCTCTGCTTCTGATTCAG AGCTGGCTAGAACAGTGCAATTTCTGCGTTCCGTCTTCGCCAA TAGCCTAGTTTATGGCGCATCCGACAGCAACGTATACGATCTCC | 698 |

TABLE 35-continued

Exemplary GHXTEN comprising growth hormones and single XTEN

| GHXTEN Name* | Amino Acid Sequence | SEQ ID NO: | DNA Nucleotide Sequence | SEQ ID NO: |
|---|---|---|---|---|
| | RKDMDKVETFLRIV QCRSVEGSCGF | | TGAAAGATCTCGAGGAAGGCATTCAGACCCTGATGGGTCGTCT CGAGGATGGCTCTCCGCGTACTGGTCAGATCTTCAAGCAGACTT ACTCTAAATTTGATACTAACAGCCACAATGACGATGCGCTTCTA AAAAAACTATGGTCTGCTGTATTGTTTTCGTAAAGATATGGACAA AGTTGAAACCTTCCTGCGTATTGTTCAGTGTCGTTCCGTTGAGG GCAGCTGTGGTTTCTAA | |
| AM923-hGH | MAEPAGSPTSTEEGA SPGTSSTGSPGSSTPS GATGSPGSSTPSGAT GSPGTSTEPSEGSAP GSEPATSGSETPGSP AGSPTSTEEGSTSST AESPGTSTPESGS ASPGSTSESPSGTAP GSTSESPSGTAPGTS TPESGSASPGTSTPES GSASPGSEPATSGSE TPGTSESATPESGPG SPAGSPTSTEEGTSTE PSEGSAPGTSESATP ESGPGTSTEPSEGSA PGTSTEPSEGSAPGSP AGSPTSTEEGTSTEPS EGSAPGTSTEPSEGS APGTSESATPESGPG TSESATPESGPGTSTE PSEGSAPGTSTEPSE GSAPGTSESATPESG PGTSTEPSEGSAPGS EPATSGSETPGSPAG SPTSTEEGSSTPSGAT GSPGTPGSGTASSSP GSSTPSGATGSPGTS TEPSEGSAPGTSTEPS EGSAPGSEPATSGSE TPGSPAGSPTSTEEG SPAGSPTSTEEGTSTE PSEGSAPGASASGAP STGGTSESATPESGP GSPAGSPTSTEEGP AGSPTSTEEGSTSST AESPGPGTSESPSGT APGTSPSGESSTAPG TPGSGTASSSPGSSTP SGATGSPGSSPSAST GTGPGSEPATSGSET PGTSESATPESGPGS EPATSGSETPGSTSST AESPGPGTSSTAESP GPGTSPSGESSTAPG SEPATSGSETPGSEP ATSGSETPGTSTEPSE GSAPGSTSSTAESPG PGTSTPESGSASPGST SESPSGTAPGTSTEPS EGSAPGTSTEPSEGS APGTSTEPSEGSAPG SSTPSGATGSPGSSPS ASTGTGPGASPGTSS TGSPGSEPATSGSET PGTSESATPESGPGSP AGSPTSTEEGSSTPS GATGSPGSSPSASTG TGPGASPGTSSTGSP GTSESATPESGPGTS TEPSEGSAPGTSTEPS EGSAPGFPTIPLSRLF DNAMLRAHRLHQL AFDTYQEFEEAYIPK EQKYSFLQNPQTSLC FSESIPTPSNREETQQ KSNLELLRISLLLIQS WLEPVQFLRSVFAN SLVYGASDSNVYDL | 699 | ATGGCTGAACCTGCTGGCTCTCCAACCTCCACTGAGGAAGGTG CATCCCCGGGCACCAGCTCTACCGGTTCTCCAGGTAGCTCTACC CCGTCTGGTGCTACCGGCTCTCCAGGTAGCTCTACCCCGTCTGG TGCTACTGGCTCTCCAGGTACTTCTACTGAACCGTCTGAAGGCA GCGCACCAGGTAGCGAACCGGCTACTTCCGGTTCTGAAACCCC AGGTAGCCCAGCAGGTTCTCCAACTTCTACTGAAGAAGGTTCTA CCAGCTCTACCGCAGAATCTCCTGGTCAGGTACCTCTACTCCG GAAAGCGGCTCTGCATCTCCAGGTTCTACTAGCGAATCTCCTTC TGGCACTGCACCAGGTTCTACTAGCGAATCCCCGTCTGGTACTG CTCCAGGTACTTCTACTCCTGAAAGCGGTTCCGCTTCTCCAGGT ACCTCTACTCCGAAAGCGGTTCTGCATCTCCAGGTAGCGAACC GGCAACCTCCGGCTCTGAAACCCAGGTACCTCTGAAAGCGCT ACTCTGAATCCGAGCGGCCCGGCAGGTTCTCCGACTTC CACTGAGGAAGGTACCTCTACTGAACCTTCTGAGGGCAGCGCT CCAGGTACTTCTGAAAGCGCTACCCCGGAGTCCGGTCAGGTA CTTCTACTGAACCGTCCGAAGGTAGCGCACCAGGTACTTCTACC GAACCGTCCGAAGGTAGCGCACCAGGTAGCCCAGCAGGTTCTC CTACCTCCACCGAGGAAGGTACTTCTACCGAACCGTCCGAGGG TAGCGCACCAGGTACTTCTACCGAACCTTCCGAGGGCAGCGCA CCAGGTACTTCTGAAAGCGCTACCCCTGAGTCCGGCCCAGGTA CTTCTGAAAGCGCTACTCCTGAAAGCGGTCCAGGTACCTCTACT GAACCTTCCGAAGGCAGCGCTCCAGGTACCTCTACCGAACCGT CCGAGGGCAGCGCACCAGGTACTTCTGAAAGCGCTAACCCCTGA ATCCGGTCCAGGTACTTCTACTGAACCTTCCGAAGGTAGCGCTC CAGGTAGCGAACCTGCTACTTCTGGTTCTGAAACCCCAGGTAGC CCGGCTGGCTCTCCGACCTCCACCGAGGAAGGTAGCTCTACCC CGTCTGGTGCTACTGGTTCTCCAGGTACTCCGGGCAGCGGTACTG CTTCTTCCTCTCCAGGTAGCTCTACCCCTTCTGGTGCTACTGGCT CTCCAGGTACCTCTACCGAACCGTCCGAGGGTAGCGCACCAGG TACCTCTACTGAACCGTCTGAGGGTAGCGCTCCAGGTAGCGAA CCGGCAACCTCCGGTTCTGAAACTCCAGGTAGCCCTGCTGGCTC TCCGACTTCTACTGAGGAAGGTAGCCCGGCTGGTTCTCCGACTT CTACTGAGGAAGGTACTTCTACCGAACCTTCCGAAGGTAGCGC TCCAGGTGCAAGCGCAAGCGGTGCACCCAGCACGGGAGGTACT TCTGAAAGCGCTACTCCGGAGTCCGGCCCAGGTAGCCCGGCTG GCTCTCCGACTTCCACCGAGGAAGGTAGCCCGGCTGGCTCTCCA ACTTCTACTGAAGAAGGTTCTACCAGCTCTACCGCTGAATCTCC TGGCCCAGGTTCTACTAGCGAATCTCCTGGCACCGCACCAG GTACTTCCCCTAGCGGTGAATCTTCTACTGCACCAGGTACCCCT GGCAGCGGTACCGCTTCTTCCTCTCCAGGTAGCTCTACCCCGTC TGGTGCTACTGGCTCTCCAGGTTCTAGCCCGTCTGCATCTACCG GTACCGGCCCAGGTAGCGAACCGGCAACCTCCGGCTCTGAAAC TCCAGGTACTTCTGAAAGCGCTACTCCGGAATCCGGCCCAGGT AGCGAACCGGCTACTTCCGGCTCTGAAACCCCAGGTTCCACCA GCTCTACTGCAGAATCTCCGGGCCCAGGTTCTACTAGCTCTACT GCAGAATCTCCGGGTCCAGGTACTTCTCCTAGCGGCGAATCTTC TACCGCTCCAGGTAGCGAACCGGCAACCTCTGGCTCTGAAACT CCAGGTAGCGAACCTGCAACCTCCGGCTCTGAAACCCCAGGTA CTTCTACTGAACCTTCTGAGGGCAGCGCACCAGGTTCTACCAGC TCTACCGCAGAATCTCCTGGTCAGGTACCTCTACTCCGGAAAG CGGCTCTGCATCTCCAGGTTCTACTAGCGAATCTCCTTCTGGCA CTGCACCAGGTACTTCTACCGAACCGTCCGAAGGCAGCGCTCC AGGTACCTCTACTGAACCTTCTGAAGGTAGCGCACCAGGTAGCT CTACTCCGTCTGGTGCAACCGGCTCCCAGGTTCTAGCCCGTCGCTTCCA TGGTACTGGCCCAGGTGCTTCCCGGGCACCAGCTCTACTGGTT CTCCAGGTAGCGAACCTGCTACCTCCGGTTCTGAAACCCCAGGT ACCTCTGAAAGCGCAACTCCGGAGTCTGGTCCAGGTAGCCCTG CAGGTTCTCTACCCCACTGAGGAAGGTAGCTCTACTCCGTCT GGTGCAACCGGCTCCCCAGGTTCTAGCCCGTCGCTTCCACTGG TACTGGCCCAGGTGCTTCCCGGGCACCAGCTCTACTGGTTCTC CAGGTACCTCTGAAAGCGCTACTCCGGAGTCTGGCCCAGGTAC TTCTGAACCGTCCGAGGGTAGCGCTCCAGGTTTTCCGACTATTCCGCTG TCTCGTCTGTTTGATAATGCTATGCTGCGTGCGCACCGTCTGCA CCAGCTGGCCTTTGATACTTACCAGGAATTTGAAGAAGCcTACA TTCCTAAAGAGCAGAAGTACTCTTTCCTGCAAAACCCACAGACT TCTCTCTGCTTCAGCGAATCTATTCCGACGCCTTCCAATCGCGA | 700 |

TABLE 35-continued

Exemplary GHXTEN comprising growth hormones and single XTEN

| GHXTEN Name* | Amino Acid Sequence | SEQ ID NO: | DNA Nucleotide Sequence | SEQ ID NO: |
|---|---|---|---|---|
| | LKDLEEGIQTLMGRL EDGSPRTGQIFKQTY SKFDTNSHNDDALL KNYGLLYCFRKDMD KVETFLRIVQCRSVE GSCGF | | GGAAACTCAGCAAAAGTCCAATCTGGAACTACTCCGCATTTCTC TGCTTCTGATTCAGAGCTGGCTAGAACCAGTGCAATTTCTGCGT TCCGTCTTCGCCAATAGCCTAGTTTATGGCGCATCCGACAGCA CGTATACGATCTCCTGAAAGATCTCGAGGAAGGCATTCAGACC CTGATGGGTCGTCTCGAGGATGGCTCTCCGCGTACTGGTCAGAT CTTCAAGCAGACTTACTCTAAATTTGATACTAACAGCCACAATG ACGATGCGCTTCTAAAAAACTATGGTCTGCTGTATTGTTTTCGT AAAGATATGGACAAAGTTGAAACCTTCCTGCGTATTGTTCAGTG TCGTTCCGTTGAGGGCAGCTGTGGTTTCTAA | |
| AM1318-hGH | GTSTEPSEGSAPGSE PATSGSETPGSPAGS PTSTEEGSTSSTAESP GPGTSTPESGSASPG STSESPSGTAPGSTSE SPSGTAPGSTSTPESGS ASPGTSTPESGSASP GSEPATSGSETPGTS ESATPESGPGSPAGS PTSTEEGTSTEPSEGS APGTSESATPESGPG TSTEPSEGSAPGTSTE PSEGSAPGSPAGSPT STEEGTSTEPSEGSAP GTSTEPSEGSAPGTS ESATPESGPGTSESA TPESGPGTSTEPSEGS APGTSTEPSEGSAPG TSESATPESGPGTSTE PSEGSAPGSEPATSG SETPGSPAGSPTSTEE GSSTPSGATGSPGTP GSGTASSSPGSSTPS GATGSPGTSTEPSEG SAPGTSTEPSEGSAP GSEPATSGSETPGSP AGSPTSTEEGSPAGS PTSTEEGTSTEPSEGS APGPEPTGPAPSGGS EPATSGSETPGTSES ATPESGPGSPAGSPT STEEGTSESATPESGP GSPAGSPTSTEEGSP AGSPTSTEEGTSESA TPESGPGSPAGSPTST EEGSPAGSPTSTEEG STSSTAESPGPGSTSE SPSGTAPGTSPSGESS TAPGSTSESPSGTAP GSTSESPSGTAPGTSP SGESSTAPGTSTEPSE GSAPGTSESATPESG PGTSESATPESGPGS EPATSGSETPGTSES ATPESGPGTSESATP ESGPGTSTEPSEGSA PGTSESATPESGPGT STEPSEGSAPGTSPSG ESSTAPGTSPSGESST APGTSPSGESSTAPG TSTEPSEGSAPGSPA GSPTSTEEGTSTEPSE GSAPGSSPSASTGTG PGSSTPSGATGSPGS STPSGATGSPGSSTPS GATGSPGSSTPSGAT GSPGASPGTSSTGSP GASASGAPSTGGTSP SGESSTAPGSTSSTA ESPGPGTSPSGESSTA PGTSESATPESGPGT STEPSEGSAPGTSTEP SEGSAPGSSPSASTG TGPGSSTPSGATGSP GASPGTSSTGSPGTS | 701 | GGTACTTCTACTGAACCGTCTGAAGGCAGCGCACCAGGTAGCG AACCGGCTACTTCCGGTTCTGAAACCCCAGGTAGCCCAGCAGG TTCTCCAACTTCTACTGAAGAAGGTTCTACCAGCTCTACCGCAG AATCTCCTGGTCCAGGTACCTCTACTCCGGAAAGCGGCTCTGCA TCTCCAGGTTCTACTAGCGAATCTCCTTCTGGCACTGCACCAGG TTCTACTAGCGAATCCCCGTCTGGTACTGCTCCAGGTACTTCTA CTCCTGAAAGCGGTTCCGCTTCTCCAGGTACCTCTACTCCGGAA AGCGGTTCTGCATCTCCAGGTAGCGAACCGGCAACCTCCGGCT CTGAAACCCCAGGTACCTCTGAAAGCGCTACTCCTGAATCCGG CCCAGGTAGCCCGGCAGGTTCTCCACTTCCACTGAGGAAGGT ACCTCTACTGAACCTTCTGAGGGCAGCGCTCCAGGTACTTCTGA AAGCGCTACCCCGGAGTCCGGTCCAGGTACTTCTACTGAACCGT CCGAAGGTAGCGCACCAGGTACTTCTACCGAACCGTCCGAGGG TAGCGCACCAGGTACTTCTACCGAACCGTCCGAGGGCAGCGCAC CAGGTACTTCTACCGAACCTTCCGAGGGCAGCGCACCAGGTACTTCTGAA AGCGCTACCCCTGAGTCCGGCCCAGGTACTTCTGAAAGCGCTA CTCCTGAATCCGGTCCAGGTACCTCTACTGAACCGTCCGAGGC AGCGCTCCAGGTACCTCTACCGAACCGTCCGAGGGCAGCGCAC CAGGTACTTCTGAAAGCGCAACCCCTGAATCCGGTCCAGGTAC TTCTACTGAACCTTCCGAAGGTAGCGCTCCAGGTAGCGAACCTG CTACTTCTGGTTCTGAAACCCCAGGTAGCCCGGCTGGCTCTCCG ACCTCCACCGAGGAAGGTAGCTCTACCCCGTCTGGTGCTACTGG TTCTCCAGGTACTCCGGGCAGCGGTACTGCTTCTTCCTCTCCAG GTAGCTCTACCCCTTCTGGTGCTACTGGCTCTCCAGGTACCTCT ACCGAACCGTCCGAGGGTAGCGCACCAGGTACCTCTACTGAAC CGTCTGAGGGTAGCGCTCCAGGTAGCGAACCGGCAACCTCCGG TTCTGAAACTCCAGGTAGCCCTGCTGGCTCTCCGACTTCTACTG AGGAAGGTAGCCCGGCTGGTTCTCCGACTTCTACTGAGGAAGG TACTTCTACCGAACCTTCCGAAGGTAGCGCTCCAGGTCCAGAAC CAACGGGCCCCGCCCAAGCGGAACCGGCAACCTC CGGCTCTGAAACCCCAGGTACCTCTGAAAGCGCTACTCCTGAAT CCGGCCCAGGTAGCCCGGCAGGTTCTCCGACTTCCACTGAGGA AGGTACTTCTGAAAGCGCTACTCCTGAGTCCGGCCCAGGTAGC CCGGCTGGCTCTCCAACTTCTACTGAAGAAGGTACTTCTGAAAGCGCTACT CCTGAGTCCGGCCCAGGTAGCCCGGCTGGCTCTCCGACTTCCAC CGAGGAAGGTAGCCCGGCTGGCTCTCCAACTTCTACTGAAGAA GGTTCTACCAGCTCTACCGCTGAATCTCCGGGTCCAGGTTCTAC TAGCGAATCTCCGTCTGGCACCGCACCAGGTACTTCCCCCTAGCG GTGAATCTTCTACTGCACCAGGTTCTACCAGCGAATCTCCTTCT GGCACCGCTCCAGGTTCTACTAGCGAATCCCCGTCTGGTACCGC ACCAGGTACTTCTCCTAGCGCACCAGGTA CTTCTACCGAACCTTCCGAGGGCAGCGCACCAGGTACTTCTGAA AGCGCTACCCCTGAGTCCGGCCCAGGTACTTCTGAAAGCGCTA CTCCTGAATCCGGTCCAGGTAGCGAACCGGCAACCTCTGGCTCT GAAACCCCAGGTACCTCTGAAAGCGCTACTCCTGGAATCCGGTC CAGGTACTTCTGAAAGCGCTACTCCGGAATCCGGTCAGGTC CAGGTACTTCTGAAAGCGCTACTCCGGAATCCGGTCAGGTC CTCTACTGAACCTTCTGAGGGCAGCGCTCCAGGTACTTCTGAAA GCGCTACCCCGGAGTCCGGTCCAGGTACTTCTACTGAACCGTCC GAAGGTAGCGCACCAGGTACCTCCCTAGCGGCGAATCTTCTA CTGCTCCAGGTACCTCTACTTCTACCGCTCCA GGTACCTCCAGGTACTTCCTACCGCACCAGGTACTTC TACCGAACCGTCCGAGGGTAGCGCACCAGGTAGCCCAGCAGGT TCTCCTACCTCCACCGAGGAAGGTACTTCTACCGAACCGTCCGA GGGTAGCGCACCAGGTTCTAGCCCTTCTGCTTCCACCGGTACG GGCCCAGGTAGCTCTACTCCGTCTGGTGCAACTGGCTCTCCAGGT AGCTCTACCCCGTCTGGTGCAACCGGCTCCCCAGGTAGCTCTAC CCCGTCTGGTGCTACCGGCTCTCCAGGTAGCTCTACCCCGTCTG GTGCAACCGGCTCTCCAGGTAGCATCCCCGGTACTAGCTCTAC GGTTCTCAGGTCAAGCGCAAGCGGCGCGCAAGCACGGGAG GTACTTCTCCGAGCGGTGAATCTTCTACCGCACCAGGTTCTACT AGCTCTACCGCTGAATCTCCGGGCCCAGGTACTTCTCCGAGCGG TGAATCTTCTACTGCTCCAGGTACCTCTGAAAGCGCTACTCCGG AGTCTGGCCCAGGTACCTCTACTGAACCGTCTGAGGGTAGCGCT | 702 |

TABLE 35-continued

Exemplary GHXTEN comprising growth hormones and single XTEN

| GHXTEN Name* | Amino Acid Sequence | SEQ ID NO: | DNA Nucleotide Sequence | SEQ ID NO: |
|---|---|---|---|---|
| | TPESGSASPGTSPSGE SSTAPGTSPSGESSTA PGTSESATPESGPGS EPATSGSETPGTSTEP SEGSAPGSTSESPSGT APGSTSESPSGTAPG TSTPESGSASPGSPA GSPTSTEEGTSESATP ESGPGTSTEPSEGSA PGSPAGSPTSTEEGT SESATPESGPGSEPA TSGSETPGSSTPSGA TGSPGASPGTSSTGS PGSSTPSGATGSPGS TSESPSGTAPGTSPSG ESSTAPGSTSSTAESP GPGSSTPSGATGSPG ASPGTSSTGSPGTPG SGTASSSPGSPAGSP TSTEEGSPAGSPTSTE EGTSTEPSEGSAPGF PTIPLSRLFDNAMLR AHRLHQLAFDTYQE FEEAYIPKEQKYSFL QNPQTSLCFSESIPTP SNREETQQKSNLELL RISLLLIQSWLEPVQF LRSVFANSLVYGAS DSNVYDLLKDLEEGI QTLMGRLEDGSPRT GQIFKQTYSKFDTNS HNDDALLKNYGLLY CFRKDMDKVETFLRI VQCRSVEGSCGF | | CCAGGTACTTCTACTGAACCGTCCGAAGGTAGCGCACCAGGTT CTAGCCCTTCTGCATCTACTGGTACTGGCCCAGGTAGCTCTACT CCTTCTGGTGCTACCGGCTCTCCAGGTGCTTCTCCGGGTACTAG CTCTACCGGTTCTCCAGGTACTTCTACTCCGGAAAGCGGTTCCG CATCTCCAGGTACTTCTCCTAGCGGTGAATCTTCTACTGCTCCA GGTACCTCTCCTAGCGGCGAATCTTCTACTGCTCCAGGTACTTC TGAAAGCGCAACCCCTGAATCCGGTCCAGGTAGCGAACCGGCT ACTTCTGGCTCTGAGACTCCAGGTACTTCTACCGAACCGTCCGA AGGTAGCGCACCAGGTTCTACCAGCGAATCCCCTTCTGGTACTG CTCCAGGTTCTACCAGCGAATCCCCTTCTGGCACCGCACCAGGT ACTTCTACCCCTGAAAGCGGCTCCGCTTCTCCAGGTAGCCCGGC AGGCTCTCCGACCTCTACTGAGGAAGGTACTTCTGAAAGCGCA ACCCCGGAGTCCGGCCCAGGTACCTCTACCGAACCGTCTGAGG GCAGCGCACCAGGTAGCCCTGCTGGCTCTCCAACCTCCACCGA AGAAGGTACTCTGAAAGCGCAACCCCTGAATCCGGCCCAGGT AGCGAACCGGCAGCTCCAGGTTCTGAAACCCCAGGTAGCTCTA CCCCGTCTGGTGCTACCGGTTCCCCAGGTGCTTCTCCTGGTACT AGCTCTACCGGTTCTCCAGGTAGCTCTACCCCGTCTGGTGCTAC TGGCTCTCCAGGTTCTACTAGCGAATCCCCGTCTGGTACTGCTC CAGGTACTTCCCCTAGCGGTGAATCTTCTACTGCTCCAGGTTCT ACCAGCTCTACCGCAGAATCTCCGGGTCCAGGTAGCTCTACCCC TTCTGGTGCAACCGGCTCTCCAGGTGCATCCCGGGTACCAGCT CTACCGGTTCTCCAGGTACTCCGGGTAGCGGTACCGCTTCTTCC TCTCCAGGTAGCCCTGCTGGCTCTCCGACTTCTACTGAGGAAGT TAGCCCGGCTGGTTCTCCGACTTCTACTGAGGAAGGTACTTCTA CCGAACCTTCCGAAGGTAGCGCTCCAGGTTTTCCGACTATTCCG CTGTCTCGTCTGTTTGATAATGCTATGCTGCGTGCGCACCGTCT GCACCAGCTGGCTTTGATACTTACCAGGAATTTGAAGAAGCcT ACATTCCTAAAGAGCAGAAGTACTCTTTCCTGCAAAACCCACA GACTTCTCTCTGCTTCAGCGAATCTATTCCGACGCCTTCCAATC GCGAGGAAACTCAGCAAAAGTCCAATCTGGAACTACTCCGCAT TTCTCTGCTTCTGATTCAGAGCTGGCTAGAACCAGTGCAATTTC TGCGTTCCGTCTTCGCCAATAGCCTAGTTTATGGCGCATCCGAC AGCAACGTATACGATCTCCTGAAAGATCTCGAGGAAGGCATTC AGACCCTGATGGGTCGTCTCGAGGATGGCTCTCCGCGTACTGGT CAGATCTTCAAGCAGACTTACTCTAAATTTGATACTAACAGCCA CAATGACGATGCGCTTCTAAAAAACTATGGTCTGCTGTATTGTT TTCGTAAAGATATGGACAAAGTTGAAACCTTCCTGCGTATTGTT CAGTGTCGTTCCGTTGAGGGCAGCTGTGGTTTCTAA | |
| hGH-AE144 | FPTIPLSRLFDNAML RAHRLHQLAFDTYQ EFEEAYIPKEQKYSF LQNPQTSLCFSESIPT PSNREETQQKSNLEL LRISLLLIQSWLEPVQ FLRSVFANSLVYGAS DSNVYDLLKDLEEGI QTLMGRLEDGSPRT GQIFKQTYSKFDTNS HNDDALLKNYGLLY CFRKDMDKVETFLRI VQCRSVEGSCGFGG SEPATSGSETPGTSES ATPESGPGSEPATSG SETPGSPAGSPTSTEE GTSTEPSEGSAPGSE PATSGSETPGSEPAT SGSETPGSEPATSGS ETPGTSTEPSEGSAP GTSESATPESGPGSE PATSGSETPGTSTEPS EGSAP | 703 | TTTCCGACTATTCCGCTGTCTCGTCTGTTTGATAATGCTATGCTG CGTGCGCACCGTCTGCACCAGCTGGCCTTTGATACTTACCAGGA ATTTGAAGAAGCTACATTCCTAAAGAGCAGAAGTACTCTTTCC TGCAAAACCCACAGACTTCTCTCTGCTTCAGCGAATCTATTCCG ACGCCTTCCAATCGCGAGGAAACTCAGCAAAAGTCCAATCTGG AACTACTCCGCATTTCTCTGCTTCTGATTCAGAGCTGGCTAGAA CCAGTGCAATTTCTGCGTTCCGTCTTCGCCAATAGCCTAGTTTA TGGCGCATCCGACAGCAACGTATACGATCTCCTGAAAGATCTC GAGGAAGGCATTCAGACCCTGATGGGTCGTCTCGAGGATGGCT CTCCGCGTACTGGTCAGATCTTCAAGCAGACTTACTCTAAATTT GATACTAACAGCCACAATGACGATGCGCTTCTAAAAAACTATG GTCTGCTGTATTGTTTTCGTAAAGATATGGACAAAGTTGAAACC TTCCTGCGTATTGTTCAGTGTCGTTCCGTTGAGGGCAGCTGTGG TTTCTAAGGTGGTAGCGAACCGGCAACTTCCGGCTCTGAAACCC CAGGTACTTCTGAAAGCGCTACTCCTGAGTCTGGCCCAGGTAGC GAACCTGCTACCTCTGGCTCTGAAACCCCAGGTAGCCCGGCAG GCTCTCCGACTTCCACCGAGGAAGGTACCTCTACTGAACCTTCT GAGGGTAGCGCTCCAGGTAGCGAACCGGCAACCTCTGGCTCTG AAAACCCCAGGTAGCGAACCTGCTACCTCCGGCTCTGAAACTCC AGGTAGCGAACCGGCTACTTCCGGTTCTGAAACTCCAGGTACCT CTACCGAACCTTCCGAAGGCAGCGCACCAGGTACTTCTGAAAG CGCAACCCCTGAATCCGGTCCAGGTAGCGAACCGGCTACTTCT GGCTCTGAGACTCCAGGTACTTCTACCGAACCGTCCGAAGGTA GCGCACCA | 704 |
| hGH-AE288 | FPTIPLSRLFDNAML RAHRLHQLAFDTYQ EFEEAYIPKEQKYSF LQNPQTSLCFSESIPT PSNREETQQKSNLEL LRISLLLIQSWLEPVQ FLRSVFANSLVYGAS DSNVYDLLKDLEEGI QTLMGRLEDGSPRT GQIFKQTYSKFDTNS | 705 | TTTCCGACTATTCCGCTGTCTCGTCTGTTTGATAATGCTATGCTG CGTGCGCACCGTCTGCACCAGCTGGCCTTTGATACTTACCAGGA ATTTGAAGAAGCTACATTCCTAAAGAGCAGAAGTACTCTTTCC TGCAAAACCCACAGACTTCTCTCTGCTTCAGCGAATCTATTCCG ACGCCTTCCAATCGCGAGGAAACTCAGCAAAAGTCCAATCTGG AACTACTCCGCATTTCTCTGCTTCTGATTCAGAGCTGGCTAGAA CCAGTGCAATTTCTGCGTTCCGTCTTCGCCAATAGCCTAGTTTA TGGCGCATCCGACAGCAACGTATACGATCTCCTGAAAGATCTC GAGGAAGGCATTCAGACCCTGATGGGTCGTCTCGAGGATGGCT CTCCGCGTACTGGTCAGATCTTCAAGCAGACTTACTCTAAATTT | 706 |

TABLE 35-continued

Exemplary GHXTEN comprising growth hormones and single XTEN

| GHXTEN Name* | Amino Acid Sequence | SEQ ID NO: | DNA Nucleotide Sequence | SEQ ID NO: |
|---|---|---|---|---|
| | HNDDALLKNYGLLY CFRKDMDKVETFLRI VQCRSVEGSCGFGG TSESATPESGPGSEP ATSGSETPGTSESAT PESGPGSEPATSGSE TPGTSESATPESGPG TSTEPSEGSAPGSPA GSPTSTEEGTSESATP ESGPGSEPATSGSET PGTSESATPESGPGSP AGSPTSTEEGSPAGS PTSTEEGTSTEPSEGS APGTSESATPESGPG TSESATPESGPGTSES ATPESGPGSEPATSG SETPGSEPATSGSETP GSPAGSPTSTEEGTS TEPSEGSAPGTSTEPS EGSAPGSEPATSGSE TPGTSESATPESGPG TSTEPSEGSAP | | GATACTAACAGCCACAATGACGATGCGCTTCTAAAAAACTATG GTCTGCTGTATTGTTTTCGTAAAGATATGGACAAAGTTGAAACC TTCCTGCGTATTGTTCAGTGTCGTTCCGTTGAGGGCAGCTGTGG TTTCTAAGGTGGTACCTCTGAAAGCGCAACTCCTGAGTCTGGCC CAGGTAGCGAACCTGCTACCTCCGGCTCTGAGACTCCAGGTAC CTCTGAAAGCGCAACCCCGGAATCTGGTCCAGGTAGCGAACCT GCAACCTCTGGCTCTGAAACCCCAGGTACCTCTGAAAGCGCTA CTCCTGAATCTGGCCCAGGTACTTCTACTGAACCGTCCGAGGGC AGCGCACCAGGTAGCCCTGCTGGCTCTCCAACCTCCACCGAAG AAGGTACCTCTGAAAGCGCAACCCCTGAATCCGGCCCAGGTAG CGAACCGGCAACCTCCGGTTCTGAAACCCCAGGTACTTCTGAA AGCGCTACTCCTGGCTCCGGCCCAGGTAGCCCGGCTGGCTCTCC GACTTCCACCGAGGAAGGTAGCCCGGCTGGCTCTCCAACTTCTA CTGAAGAAGGTACTTCTACCGAACCTTCCGAGGGCAGCGCACC AGGTACTTCTGAAAGCGCTACCCCTGAGTCCGGCCCAGGTACTT CTGAAAGCGCTACTCCTGAATCCGGTCCAGGTACTTCTGAAAGC GCTACCCCGGAATCTGGCCCAGGTAGCGAACCGGCTACTTCTG GTTCTGAAACCCCAGGTAGCGAACCGGCTACCTCCGGTTCTGA AACTCCAGGTAGCCCAGCAGGCTCTCCGACTTCCACTGAGGAA GGTACTTCTACTGAACCTTCCGAAGGCAGCGCACCAGGTACCTC TACTGAACCTTCTGAGGGCAGCGCTCCAGGTAGCGAACCTGCA ACCTCTGGCTCTGAAACCCCAGGTACCTCTGAAAGCGCTACTCC TGAATCTGGCCCAGGTACTTCTACTGAACCGTCCGAGGGCAGC GCACCA | |
| hGH-AF144 | FPTIPLSRLFDNAML RAHRLHQLAFDTYQ EFEEAYIPKEQKYSF LQNPQTSLCFSESIPT PSNREETQQKSNLEL LRISLLLIQSWLEPVQ FLRSVFANSLVYGAS DSNVYDLLKDLEEGI QTLMGRLEDGSPRT GQIFKQTYSKFDTNS HNDDALLKNYGLLY CFRKDMDKVETFLRI VQCRSVEGSCGFGG TSTPESGSASPGTSPS GESSTAPGTSPSGESS TAPGSTSSTAESPGP GSTSESPSGTAPGSTS STAESPGPGTSPSGES STAPGTSTPESGSASP GSTSSTAESPGPGTSP SGESSTAPGTSPSGES STAPGTSPSGESSTAP | 707 | TTTCCGACTATTCCGCTGTCTCGTCTGTTTGATAATGCTATGCTG CGTGCGCACCGTCTGCACCAGCTGGCCTTTGATACTTACCAGGA ATTTGAAGAAGCTACATTCCTAAAGAGCAGAAGTACTCTTTCC TGCAAACCCACAGACTTCTCTCTGCTTCAGCGAATCTATTCCG ACGCCTTCCAATGCGAGGAAACTCAGCAAAGTCCAATCTGG AACTACTCCGCATTTCTCTGCTTCTGATTCAGAGCTGGCTAGAA CCAGTGCAATTTCTGCGTTCCGTCTTCGCCAATAGCCTAGTTTA TGGCGCATCCGACGACAACGTATACGATCTCCTGAAAGATCTC GAGGAAGGCATTCAGACCCTGATGGGTCGTCTCGAGGATGGCT CTCCGCGTACTGGTCAGATCTTCAAGCAGACTTACTCTAAATTT GATACTAACAGCCACAATGACGATGCGCTTCTAAAAAACTATG GTCTGCTGTATTGTTTTCGTAAAGATATGGACAAAGTTGAAACC TTCCTGCGTATTGTTCAGTGTCGTTCCGTTGAGGGCAGCTGTGG TTTCTAAGGTGGTACTTCTACTCCGGAAAGCGGTTCCGCATCTC CAGGTACTTCTCCTAGCGGTGAATCTTCTACTGCTCCAGGTACC TCTCCTAGCGGCGAATCTTCTACTGCTCCAGGTTCTACAGCTC TACCGCTGAATCTCCTGGCCCAGGTTCTACCAGCGAATCCCCGT CTGGCACCGCACCAGGTTCTACTAGCCTACCGCAGAATCTCCG GGTCCAGGTACTTCCCCTAGCGGTGAATCTTCTACTGCTCCAGG TACCTCTACTCCGGAAAGCGGCTCCGCATCTCCAGGTTCTACTA GCTCTACTGCTGAATCTCCTGGTCCAGGTACCTCCCCTAGCGGC GAATCTTCTACTGCTCCAGGTACCTCTCCTAGCGGCGAATCTTC TACCGCTCCAGGTACCTCCCCTAGCGGTGAATCTTCTACCGCAC CA | 708 |
| hGH-AD576 | FPTIPLSRLFDNAML RAHRLHQLAFDTYQ EFEEAYIPKEQKYSF LQNPQTSLCFSESIPT PSNREETQQKSNLEL LRISLLLIQSWLEPVQ FLRSVFANSLVYGAS DSNVYDLLKDLEEGI QTLMGRLEDGSPRT GQIFKQTYSKFDTNS HNDDALLKNYGLLY CFRKDMDKVETFLRI VQCRSVEGSCGFGG SSESGSSEGGPGSGG EPSESGSSGSSESGSS EGGPGSSESGSSEGG PGSSESGSSEGGPGS SESGSSEGGPGSSES GSSEGGPGESPGGSS GSESGSSEGSSGPGES SGSSESGSSEGGPGS SESGSSEGGPGSSES GSSEGGPGSGGEPSE SGSSGESPGGSSGSE SGESPGGSSGSESGS | 709 | TTTCCGACTATTCCGCTGTCTCGTCTGTTTGATAATGCTATGCTG CGTGCGCACCGTCTGCACCAGCTGGCCTTTGATACTTACCAGGA ATTTGAAGAAGCTACATTCCTAAAGAGCAGAAGTACTCTTTCC TGCAAACCCACAGACTTCTCTCTGCTTCAGCGAATCTATTCCG ACGCCTTCCAATGCGAGGAAACTCAGCAAAGTCCAATCTGG AACTACTCCGCATTTCTCTGCTTCTGATTCAGAGCTGGCTAGAA CCAGTGCAATTTCTGCGTTCCGTCTTCGCCAATAGCCTAGTTTA TGGCGCATCCGACGACAACGTATACGATCTCCTGAAAGATCTC GAGGAAGGCATTCAGACCCTGATGGGTCGTCTCGAGGATGGCT CTCCGCGTACTGGTCAGATCTTCAAGCAGACTTACTCTAAATTT GATACTAACAGCCACAATGACGATGCGCTTCTAAAAAACTATG GTCTGCTGTATTGTTTTCGTAAAGATATGGACAAAGTTGAAACC TTCCTGCGTATTGTTCAGTGTCGTTCCGTTGAGGGCAGCTGTGG TTTCTAAGGTGGTTCCTCTGAAAGCGGTTCTTCCGAAGGTGGTC CAGGTTCCTCTGAAAGCGGTTCTTCTGAGGGTGGTCCAGGTGAA TCTCCGGGTGGCTCCAGGTCAGTCAGGTTCTGGTGGCA ACCTTCCGAGTCTGGTAGCTCAGGTGAATCTCCGGGTGGTTCTA GCGGTTCCGAGTCAGGTGAATCTCCGGGTGGTTCCAGCGGTTCT GAGTCAGGTTCCTCCGAAAGCGGTTCTTCTGAGGGCGGTCCAG GTTCCTCCGAAAGCGGTTCTTCCGAGGGCGGTCCAGGTTCTTCT GAAAGCGGTTCTTCCGAGGGCGGTCCAGGTGAATCTCCTGGTG GTTCCAGCGGTTCCGAGTCAGGTGAATCTCCAGGTGGCTCTAGC GGTTCCGAGTCAGGTGAATCTCCTGGTGGTTCTAGCGGTTCTGA ATCAGGTTCCTCCGAAAGCGGTTCTTCTGAGGGCGGTCCAGGTT CCTCCGAAAGCGGTTCTTCCGAGGGCGGTCCAGGTTCTTCTGAA | 710 |

TABLE 35-continued

Exemplary GHXTEN comprising growth hormones and single XTEN

| GHXTEN Name* | Amino Acid Sequence | SEQ ID NO: | DNA Nucleotide Sequence | SEQ ID NO: |
|---|---|---|---|---|
| | GGEPSESGSSGSSES GSSEGGPGSGGEPSE SGSSGSSGGEPSESGS SGSEGSSGPGESSGE SPGGSSGSESGSGGE PSESGSSGSGGEPSES GSSGSGGEPSESGSS GSSESGSSEGGPGES PGGSSGSESGESPGG SSGSESGESPGGSSG SESGESPGGSSGSES GESPGGSSGSESGSS ESGSSEGGPGSGGEP SESGSSGSEGSSGPG ESSGSSESGSSEGGP GSGGEPSESGSSGSS ESGSSEGGPGSGGEP SESGSSGESPGGSSG SESGESPGGSSGSES GSSEGSSEGGPGSG GEPSESGSSGSSESGS SEGGPGSGGEPSESG SSGSGGEPSESGSSG ESPGGSSGSESGSEG SSGPGESSGSSESGSS EGGPGSEGSSGPGESS | | AGCGGTTCTTCCGAGGGCGGTCCAGGTTCCTCTGAAAGCGGTTC TTCTGAGGGCGGTCCAGGTTCTTCCGAAAGCGGTTCTTCCGAGG GCGGTCCAGGTTCTTCCGAAAGCGGTTCTTCTGAAGGCGGTCCA GGTTCTGGTGGCGAACCGTCCGAGTCTGGTAGCTCAGGTGAAT CTCCCGGGTGGCTCTAGCGGTTCCGAGTCAGGTAATCTCCTGGT GGTTCCAGCGGTTCCGAGTCAGGTTCCGGTGGCGAACCGTCCG AATCTGGTAGCTCAGGTAGCGAAGGTTCTTCTGGTCCAGGCGA ATCTTCAGGTTCCTCTGAAAGCGGTTCTTCTGAGGGCGGTCCAG GTTCCGGTGGCGAACCGTCCGAATCTGGTAGCTCAGGTAGCGA AGGTTCTTCTGGTCCAGGCGAATCTTCAGGTTCCTCTGAAAGCG GTTCTTCTGAGGGCGGTCCAGGTTCCGGTGGCGAACCTTCCGAA TCTGGTAGCTCAGGTGAATCTCCCGGTGGTTCTAGCGGTTCTGA GTCAGGTTCTGGTGGTGAACCTTCCGAGTCTGGTAGCTCAGGTT CTGGTGGCGAACCATCCGAGTCTGGTAGCTCAGGTTCTTCCGAA AGCGGTTCTTCCGAAGGCGGTCCAGGTTCTGGTGGTGAACCGTC CGAATCTGGTAGCTCAGGTTCTGGTGGCGAACCATCCGAATCTG GTAGCTCAGGTAGCGAAGGTTCTTCTGGTCCTGGCGAATCTTCA GGTGAATCTCCAGGTGGCTCTAGCGGTTCCGAATCAGGTAGCG AAGGTTCTTCCGGTCCAGGTGAATCTTCAGGTAGCGAAGGTTCT TCTGGTCCTGGTGGCGAACCTTCCGGTTCCGGTGGCGAACCATCTGA ATCTGGTAGCTCAGGTTCCTCTGAAAGCGGTTCTTCCGAAGGTG GTCCAGGTTCCTCTGAAAGCGGTTCTTCTGAGGGTGGTCCAGGT GAATCTCCGGGTGCTCCAGCGGTTCCGAGTCAGGTTCTGGTGG CGAACCATCCGAATCTGGTAGCTCAGGTAGCGAAGGTTCTTCTG GTCCTGGCGAATCTTCAGGTGAATCTCCAGGTGGCTCTAGCGGT TCCGAATCAGGTAGCGAAGGTTCTTCCGGTCCTGGTGAGTCTTC AGGTGAATCTCCAGGTGGCTCTAGCGGTTCCGAGTCAGGTAGC GAAGGTTCTTCTGGTCCTGGCGAGTCCTCA | |
| hGH-AE576 | FPTIPLSRLFDNAML RAHRLHQLAFDTYQ EFEEAYIPKEQKYSF LQNPQTSLCFSESIPT PSNREETQQKSNLEL LRISLLLIQSWLEPVQ FLRSVFANSLVYGAS DSNVYDLLKDLEEGI QTLMGRLEDGSPRT GQIFKQTYSKFDTNS HNDDALLKNYGLLY CFRKDMDKVETFLRI VQCRSVEGSCGFGG SPAGSPTSTEEGTSES ATPESGPGTSTEPSE GSAPGSPAGSPTSTE EGTSTEPSEGSAPGT STEPSEGSAPGTSES ATPESGPGSEPATSG SETPGSEPATSGSETP GSPAGSPTSTEEGTS ESATPESGPGTSTEPS EGSAPGTSTEPSEGS APGSPAGSPTSTEEG TSTEPSEGSAPGTSTE PSEGSAPGTSESATP ESGPGTSTEPSEGSA PGTSESATPESGPGS EPATSGSETPGTSTEP SEGSAPGTSTEPSEG SAPGTSESATPESGP GTSESATPESGPGSP AGSPTSTEEGTSESA TPESGPGSEPATSGS ETPGTSESATPESGP GTSTEPSEGSAPGTS TEPSEGSAPGTSTEPS EGSAPGTSTEPSEGS APGTSTEPSEGSAPG TSTEPSEGSAPGSPA GSPTSTEEGTSTEPSE GSAPGTSESATPESG PGSEPATSGSETPGT SESATPESGPGSEPA TSGSETPGTSESATPE SGPGTSTEPSEGSAP | 711 | TTTCCGACTATTCCGCTGTCTCGTCTGTTTGATAATGCTATGCTG CGTGCGCACCGTCTGCACCAGCTGGCCTTTGATACTTACCAGGA ATTTGAAGAAGCTTACATTCCTAAAGAGCAGAAGTACTCTTTCC TGCAAAACCCACAGACTTCTCTCTGCTTCAGCGAATCTATTCCG ACGCCTTCCAATCGCGAGGAAACTCAGCAAAAGTCCAATCTGG AACTACTCCGCATTTCTCTGCTTCTGATTCAGAGCTGGCTAGAA CCAGTGCAATTTCTGCGTTCCGTCTTCGCCAATAGCCTAGTTTA TGGCGCATCCGACGACAACGTATACGATCTCCTGAAAGATCTC GAGGAAGGCATTCAGACCCTGATGGGTCGTCTCGAGGATGGCT CTCCGCGTACTGGTCAGATCTTCAAGCAGACTTACTCTAAATTT GATACTAACAGCCACAATGACGATGCGCTTCTAAAAAACTATG GTCTGCTGTATTGTTTTCGTAAAGATATGGACAAAGTTGAAACC TTCCTGCGTATTGTTCAGTGTCGTTCCGTTGAGGGCAGCTGTGG TTTTGGTGGTAGCCCGGCTGGCTCTCCTACCTCTACTGAGG AAGGTACTTCTGAAAGCGCTACTCCTGAGTCTGGTCCAGGTACC TCTACTGAACCGTCCGAAGGTAGCGCTCCAGGTAGCCCAGCAG GCTCTCCGACTTCCACTGAGGAAGGTACTTCTACTGAACCTTCC GAAGGCAGCGCACCAGGTACCTCTACTGAACCTTCTGAGGGCA GCGCTCCAGGTACTTCTGAAAGCGCTACCCCGGAATCTGGCCC AGGTAGCGAACCGGCTACTTCTGGTTCTGAAACCCCAGGTAG GAACCGGCTACCTCCGGTTCTGAAACTCCAGGTAGCCCGGCAG GCTCTCCGACCTCTACTGAGGAAGGTACTTCTGAAAGCGCTAAC CCCGGAGTCCGGCCCAGGTACCTCTACCGAACCGTCTGAGGGC AGCGCACCAGGTACTTCTACCGAACCGTCCGAGGGTAGCGCAG CAGGTAGCCCAGCAGGTTCTCCTACCTCCACCGAGGAAGGTAC TTCTACCGAACCGTCCGAGGGTAGCGCACCAGGTACCTCTACTG AACTTCTGAGGGCAGCGCTCCAGGTACTTCTGAAAGCGCTAC CCCGGAGTCCGGTCCAGGTACTTCTACTGAACCGTCCGAAGGT AGCGCACCAGGTACTTCTGAAAGCGCAACCCCTGAATCCGGTC CAGGTAGCGAACCGGCTACTTCTGGCTCTGAGACTCCAGGTACT TCTACCGAACCGTCCGAAGGTAGCGCACCAGGTACTTCTACTG AACCGTCTGAAGGTAGCGCACCAGGTACTTCTGAAAGCGCAAC CCCGGAATCCGGTCCAGGTACCTCTGAAAGCGCAACCCCGGAG GCCACCAGGTACTTCTACTGAACCGTCCGAAGGCAGCGCTCC AGGGTAGCGCTCCAGGTACTTCTACCGAACCGTCCGAAGGCAGCGCTCC AGGTACCTCTACTGAACCTTCCGAGGGCAGCGCTCCAGGTACCT CTACCGAACCTTCTGAAGGTAGCGCACCAGGTACTTCTACGA ACCGTCCGAGGGTAGCGCACCAGGTAGCCCAGCAGGTTCTCCT ACCTCCACCGAGGAAGGTACTTCTACCGAACCGTCCGAGGGTA GCGCACCAGGTACTCTGAAAGCGCAACCCCTGAGTCTGGCCC AGGTAGCGAACCTGCTACTCCGGCTCTGAGACTCCAGGTACCT CTGAAAGCGCAACCCCGGAATCTGGTCCAGGTAGCGAACCTGC | 712 |

TABLE 35-continued

Exemplary GHXTEN comprising growth hormones and single XTEN

| GHXTEN Name* | Amino Acid Sequence | SEQ ID NO: | DNA Nucleotide Sequence | SEQ ID NO: |
|---|---|---|---|---|
| | GTSESATPESGPGSP AGSPTSTEEGSPAGS PTSTEEGSPAGSPTST EEGTSESATPESGPG TSTEPSEGSAP | | AACCTCTGGCTCTGAAACCCCAGGTACCTCTGAAAGCGCTACTC CTGAATCTGGCCCAGGTACTTCTACTGAACCGTCCGAGGGCAG CGCACCAGGTACTTCTGAAAGCGGTACTCCTGAGTCCGGCCCA GGTAGCCCGGCTGGCTCTCCGACTTCCACCGAGGAAGGTAGCC CGGCTGGCTCTCCAACTTCTACTGAAGAAGGTAGCCCGGCAGG CTCTCCGACCTCTACTGAGGAAGGTACTTCTGAAAGCGCAACCC CGGAGTCCGGCCCAGGTACCTCTACCGAACCGTCTGAGGGCAG CGCACCA | |
| hGH-AF576 | FPTIPLSRLFDNAML RAHRLHQLAFDTYQ EFEEAYIPKEQKYSF LQNPQTSLCFSESIPT PSNREETQQKSNLEL LRISLLLIQSWLEPVQ FLRSVFANSLVYGAS DSNVYDLLKDLEEGI QTLMGRLEDGSPRT GQIFKQTYSKFDTNS HNDDALLKNYGLLY CFRKDMDKVETFLRI VQCRSVEGSCGFGG STSSTAESPGPGSTSS TAESPGPGSTSESPSG TAPGSTSSTAESPGP GSTSSTAESPGPGTS TPESGSASPGSTSESP SGTAPGTSPSGESST APGSTSESPSGTAPG STSESPSGTAPGTSPS GESSTAPGSTSESPSG TAPGSTSESPSGTAP GTSPSGESSTAPGSTS ESPSGTAPGSTSESPS GTAPGSTSESPSGTA PGTSTPESGSASPGST SESPSGTAPGTSTPES GSASPGSTSSTAESP GPGSTSSTAESPGPG TSTPESGSASPGTSTP ESGSASPGSTSESPSG TAPGTSTPESGSASP GTSTPESGSASPGSTS ESPSGTAPGSTSESPS GTAPGSTSESPSGTA PGTSSTAESPGPGTS TPESGSASPGTSTPES GSASPGSTSESPSGT APGSTSESPSGTAPG TSTPESGSASPGSTSE SPSGTAPGSTSESPSG TAPGTSTPESGSASP GTSPSGESSTAPGSTS STAESPGPGTSPSGES STAPGSTSSTAESPGP GTSTPESGSASPGSTS ESPSGTAPGSTSSTA ESPGPGTSTPESGSAS PGTSTPESGSASP | 713 | TTTCCGACTATTCCGCTGTCTCGTCTGTTTGATAATGCTATGCTG CGTGCGCACCGTCTGCACCAGCTGGCCTTTGATACTTACCAGGA ATTTGAAGAAGCGTACATTCCTAAAGAGCAGAAGTACTCTTTCC TGCAAAACCCACAGACTTCTCTCTGCTTCAGCGAATCTATTCCG ACGCCTTCCAATCGCGAGGAAACTCAGCAAAAGTCCAATCTGG AACTACTCCGCATTTCTCTGCTTCTGATTCAGAGCTGGCTAGAA CCAGTGCAATTTCTGCGTTCCGCTCTTCGCCAATAGCCTAGTTTA TGGCGCATCCGACAGCAACGTATACGATCTCCTGAAAGATCTC GAGGAAGGCATTCAGACCCTGATGGGTCGTCTCGAGGATGGCT CTCCGCGTACTGGTCAGATCTTCAAGCAGACTTACTCTAAATTT GATACTAACAGCCACAATGACGATGCGCTTCTAAAAAACTATG GTCTGCTGTATTGTTTTCGTAAAGATATGGACAAAGTTGAAACC TTCCTGCGTATTGTTCAGTGTCGTTCCGTTGAGGGCAGCTGTGG TTTTCTAAGGTGGTTCTACTAGCTCTACCGCTGAATCTCCTGGCC CAGGTTCCACTAGCTCTACCGCAGAATCTCCGGGCCCAGGTTCT ACTAGCGAATCCCCTTCTGGTACCGCTCCAGGTTCTACTAGCTC TACCGCTGAATCTCCGGGTCCAGGTTCTACCAGCTCTACTGCAG AATCTCCTGGCCCAGGTACTTCTACTCCGGAAAGCGGTTCCGCT TCTCCAGGTTCTACCAGCGAATCTCCTTCTGGCACCGCTCCAGG TACCTCTCCTAGCGGCGAATCTTCTACCGCTCCAGGTTCTACTA GCGAATCTCCTTCTGGCACTGCACCAGGTTCTACCAGCGAATCT CCTTCTGGCACCGCTCCAGGTACCTCTCCTAGCGGCGAATCTTC TACCGCTCCAGGTTCTACTAGCGAATCTCCTTCTGGCACTGCAC CAGGTTCTACCAGCGAATCTCCTTCTGGCACCGCTCCAGGTACC TCTCCTAGCGGCGAATCTTCTACCGCTCCAGGTTCTACTAGCGA ATCTCCTTCTGGCACTGCACCAGGTTCTACTAGCGAATCTCCTT CTGGCACTGCACCAGGTTCTACCAGCGAATCTCCGTCTGGCACT GCACCAGGTACCTCTACCCCTGAAAGCGGTTCTGCTTCTCCAGG TTCTACTAGCGAATCTCCTTCTGGTACCGCTCCAGGTACTTCTA CCCCTGAAAGCGGCTCCGCTTCTCCAGGTACTTCTACCCCTGAA TCTGGCCCAGGTACCTCTACTCCGGAAAGCGGCTCTGCATCTCC AGGTACTTCTACCCCTGAAAGCGGTTCTGCATCTCCAGGTTCT ACTAGCGAATCCCCGTCTGGTACCGCACCAGGTACTTCTACCCC GGAAAGCGGCTCTGCTTCTCCAGGTACTTCTACCCCCGAAAGC GGCTCCGCATCTCCAGGTTCTACTAGCGAATCTCCTTCTGGTAC CGCTCCAGGTTCTACCAGCGAATCCCCGTCTGGTACTGCTCCAG GTTCTACCAGCGAATCTCCTTCTGGTACTGCACCAGGTTCTACT AGCTCTACTGCAGAATCTCCTGGCCCAGGTACCTCTACTCCGGA AAGCGGCTCTGCATCTCCAGGTACTTCTACCCCTGAAAGCGGTT CTGCATCTCCAGGTTCTACTAGCGAATCTCCTTCTGGCACTGCA CCAGGTTCTACCAGCGAATCTCCGTCTGGCACTGCACCAGGTAC CTCTACCCCTGAAAGCGGTTCCGCTTCTCCAGGTTCTACTAGCG AATCTCCTTCTGGCACCGCACCAGGTACCTCTACCAGCGAATCCG TCTGGCACTGCACCAGGTACCTCTACCCCTGAAAGCGGTTCCGC TTCTCCAGGTACTTCTCCGAGCGGTGAATCTTCTACCGCACCAG GTTCTACTAGCTCTACCGCTGAATCTCCGGGCCCAGGTACTTCT CCGAGCGGTGAATCTTCTACTGCTCCAGGTTCCACTAGCTCTAC TGCTGAATCTCCTGGCCCAGGTACTTCTACTCCGGAAAGCGGTT CCGCTTCTCCAGGTTCTACTAGCGAATCTCCGTCTGGCACCGCA CCAGGTTCTACTAGCTCTACTGCAGAATCTCCTGGCCCAGGTAC CTCTACTCCGGAAAGCGGCTCTGCATCTCCAGGTACTTCTACCC CTGAAAGCGGTTCTGCATCTCCA | 714 |
| hGH-AE624 | FPTIPLSRLFDNAML RAHRLHQLAFDTYQ EFEEAYIPKEQKYSF LQNPQTSLCFSESIPT PSNREETQQKSNLEL LRISLLLIQSWLEPVQ FLRSVFANSLVYGAS DSNVYDLLKDLEEGI QTLMGRLEDGSPRT GQIFKQTYSKFDTNS HNDDALLKNYGLLY CFRKDMDKVETFLRI | 715 | TTTCCGACTATTCCGCTGTCTCGTCTGTTTGATAATGCTATGCTG CGTGCGCACCGTCTGCACCAGCTGGCCTTTGATACTTACCAGGA ATTTGAAGAAGCGTACATTCCTAAAGAGCAGAAGTACTCTTTCC TGCAAAACCCACAGACTTCTCTCTGCTTCAGCGAATCTATTCCG ACGCCTTCCAATCGCGAGGAAACTCAGCAAAAGTCCAATCTGG AACTACTCCGCATTTCTCTGCTTCTGATTCAGAGCTGGCTAGAA CCAGTGCAATTTCTGCGTTCCGCTCTTCGCCAATAGCCTAGTTTA TGGCGCATCCGACAGCAACGTATACGATCTCCTGAAAGATCTC GAGGAAGGCATTCAGACCCTGATGGGTCGTCTCGAGGATGGCT CTCCGCGTACTGGTCAGATCTTCAAGCAGACTTACTCTAAATTT GATACTAACAGCCACAATGACGATGCGCTTCTAAAAAACTATG GTCTGCTGTATTGTTTTCGTAAAGATATGGACAAAGTTGAAACC | 716 |

TABLE 35-continued

Exemplary GHXTEN comprising growth hormones and single XTEN

| GHXTEN Name* | Amino Acid Sequence | SEQ ID NO: | DNA Nucleotide Sequence | SEQ ID NO: |
|---|---|---|---|---|
| | VQCRSVEGSCGFGM AEPAGSPTSTEEGTP GSGTASSSPGSSTPS GATGSPGASPGTSST GSPGSPAGSPTSTEE GTSESATPESGPGTS TEPSEGSAPGSPAGS PTSTEEGTSTEPSEGS APGTSTEPSEGSAPG TSESATPESGPGSEP ATSGSETPGSEPATS GSETPGSPAGSPTST EEGTSESATPESGPG TSTEPSEGSAPGTSTE PSEGSAPGSPAGSPT STEEGTSTEPSEGSAP GTSTEPSEGSAPGTS ESATPESGPGTSTEPS EGSAPGTSESATPES GPGSEPATSGSETPG TSTEPSEGSAPGTSTE PSEGSAPGTSESATP ESGPGTSESATPESG PGSPAGSPTSTEEGT SESATPESGPGSEPA TSGSETPGTSESATPE SGPGTSTEPSEGSAP GTSTEPSEGSAPGTS TEPSEGSAPGTSTEPS EGSAPGTSTEPSEGS APGTSTEPSEGSAPG SPAGSPTSTEEGTSTE PSEGSAPGTSESATP ESGPGSEPATSGSET PGTSESATPESGPGS EPATSGSETPGTSES ATPESGPGTSTEPSE GSAPGTSESATPESG PGSPAGSPTSTEEGSP AGSPTSTEEGSPAGS PTSTEEGTSESATPES GPGTSTEPSEGSAP | | TTCCTGCGTATTGTTCAGTGTCGTTCCGTTGAGGGCAGCTGTGG TTTTCTAAGGTATGGCTGAACCTGCTGGCTCTCCAACCTCCACTG AGGAAGGTACCCGGGTAGCGGTACTGCTTCTTCCTCTCCAGGT AGCTCTACCCCTTCTGGTGCAACCGGCTCTCCAGGTGCTTCTCC GGGCACCAGCTCTACCGGTTCTCCAGGTAGCCCGGCTGGCTCTC CTACCTCTACTGAGGAAGGTACTTCTGAAAGCGCTACTCCTGAG TCTGGTCCAGGTACCTCTACTGAACCGTCCGAAGGTAGCGCTCC AGGTAGCCCAGCAGGCTCTCCGACTTCCACTGAGGAAGGTACT TCTACTGAACCTTCCGAAGGCAGCGCACCAGGTACCTCTACTGA ACCTTCTGAGGGCAGCGCTCCAGGTACTTCTGAAAGCGCTACCC CGGAATCTGGCCCAGGTAGCGAACCGGCTACTTCTGGTTCTGA AACCCCAGGTAGCGAACCGGCTACCTCCGGTTCTGAAACTCCA GGTAGCCCGGCAGGCTCTCCGACCTCTACTGAGGAAGGTACTT CTGAAAGCGCAACCCCGGAGTCCGGCCCAGGTACCTCTACCGA ACCGTCTGAGGGCAGCGCACCAGGTACTTCTACCGAACCGTCC GAGGGTAGCGCACCAGGTACCTCCAGGTTCTCTACCTCCA CCGAGGAAGGTACTTCTACCGAACCGTCCGAGGGTAGCGCACC AGGTACCTCTACTGAACCTTCTGAGGGCAGCGCTCCAGGTACTT CTGAAAGCGCTACCCCGGAGTCCGGTCCAGGTACTTCTACTGA ACCGTCCGAAGGTAGCGCACCAGGTACTTCTGAAAGCGCTACCC CCTGAATCCGGTCCAGGTAGCGAACCGGCTACTTCTGGCTCTGA GACTCCAGGTACTTCTACCGAACCGTCCGAAGGTAGCGCACCA GGTACTTCTACTGAACCGTCTGAAGGTAGCGCACCAGGTACTTC TGAAAGCGCAACCCCGGAATCCGGAATCTGAAGGCAACCCCGGAGTCCGGCCAGGTAGCCCTGCTGGCTCTCCAA CCTCCACCGAAGAAGGTACCTCTGAAAGCGCAACCCCTGAATC CGGCCCAGGTAGCGAACCGGCAACCTCCGGTTCTGAAACCCCA GGTACCTCTGAAAGCGCTACTCCGGAGTCTGGCCCCAGGTACCTC TACTGAACCGTCTGAGGGTAGCGCTCCAGGTACTTCTACTGAAC CGTCCGAAGGTAGCGCACCAGGTACTTCTACCGAACCGTCCGA AGGCAGCGCTCCAGGTACCTCTACTGAACCTTCCGAGGGCAGC GCTCCAGGTACCTCTACCGAACCTTCTGAAGGTAGCGCACCAG GTACTTCTACCGAACCGTCGAGGGTAGCGCACCAGGTAGCCC AGCAGGTTCTCCTACCTCCACCGAGGAAGGTACTTCTACCGAAC CGTCCGAGGGTAGCGCACCAGGTACCTCTGAAAGCGCAACTCC TGAGTCTGGCCCAGGTAGCGAACCTGCTACCTCCGGCTCTGAG ACTCCAGGTACTTCTGAAAGCGCAACCCCCGGAATCTGGTCCAG GTAGCGAACCTGCAACCTCTGGCTCTGAAACCCCAGGTACCTCT GAAAGCGCTACTCCTGAATCTGGCCCAGGTACTTCTACTGAACC GTCCGAGGGCAGCGCACCAGGTACTTCTGAAAGCGCTACTCCT GAGTCCGGCCCAGGTAGCGGTTCTCCGACTTCCACCG AGGAAGGTAGCCCGGCTGGCTCTCCAACTTCTACTGAAGAAGG TAGCCCGGCAGGCTCTCCGACCTCTACTGAGGAAGGTACTTCTG AAAGCGCAACCCCGGAGTCCGGCCCAGGTACCTCTACCGAACC GTCTGAGGGCAGCGCACCA | |
| hGH-AD836 | FPTIPLSRLFDNAML RAHRLHQLAFDTYQ EFEEAYIPKEQKYSF LQNPQTSLCFSESIPT PSNREETQQKSNLEL LRISLLLIQSWLEPVQ FLRSVFANSLVYGAS DSNVYDLLKDLEEGI QTLMGRLEDGSPRT GQIFKQTYSKFDTNS HNDDALLKNYGLLY CFRKDMDKVETFLRI VQCRSVEGSCGFGG SSESGSSEGGPGSSES GSSEGGPGESPGGSS GSESGSGGEPSESGS SGESPGGSSGSESGE SPGGSSGSESGSSES GSSEGGPGSSESGSS EGGPGSSESGSSEGG PGESPGGSSGSESGE SPGSSGSESGESPG GSSGSESGSSESGSSE GGPGSESGSSESGGP GSSESGSSEGGPGSS ESGSSEGGPGSSESG SSEGGPGSSESGSSE GGPGSGGEPSESGSS GESPGGSSGSESGES | 717 | TTTCCGACTATTCCGCTGTCTCGTCTGTTTGATAATGCTATGCTG CGTGCGCACCGTCTGCACCAGCTGGCCTTTGATACTTACCAGGA ATTTGAAGAAGCTACATTCCTAAAGAGCAGAAGTACTCTTTCCA TGCAAAACCCACAGACTTCTCTCTGCTTCAGCGAATCTATTCCG ACGCCTTCCAATCGCGAGGAAACTCAGCAAAAGTCCAATCTGG AACTACTCCGCATTTCTCTGCTTCTGATTCAGAGCTGGCTAGAA CCAGTGCAATTTCTGCGTTCCGTCTTCGCCAATAGCCTAGTTTA TGGCGCATCCGACAGCAACGTATACGATCTCCTGAAAGATCTC GAGGAAGGCATTCAGACCCTGATGGGTCGTCTCGAGGATGGCT CTCCGCGTACTGGTCAGATCTTCAAGCAGACTTACTCTAAATTT GATACTAACAGCCACAATGACGATGCGCTTCTAAAAACTATG GTCTGCTGTATTGTTTTCGTAAAGATATGGACAAAGTTGAAACC TTCCTGCGTATTGTTCAGTGTCGTTCCGTTGAGGGCAGCTGTGG TTTTCTAAGGTGGTTCCTCTGAAAGCGGTTCTTCCGAAGGTGGTC CAGGTTCCTCTGAAAGCGGTTCTTCTGAGGGTGGTCCAGGTGAA TCTCCGGGTGGCTCCAGCGGTTCCGAGTCAGGTTCTGGTGGCGA ACCTTCCGAGTCTGGTAGCTCAGGTGAATCTCCGGGTGGTTCTA GCGGTTCCGAGTCAGGTGAATCTCCGGGTGGTTCCAGCGGTTCT GAGTCAGGTTCCTCCGAAAGCGGTTCTTCTGAGGGCGGTCCAG GTTCCTCCGAAAGCGGTTCTTCCGAGGGCGGTCCAGGTTCTTCT GAAAGCGGTTCTTCCGAGGGCGGTCCAGGTGAATCTCCTGGTG GTTCCAGCGGTTCCGAGTCAGGTGAATCTCCAGGTGGCTCTAGC GGTTCCGAGTCAGGTGAATCTCCTGGTGGTTCTAGCGGTTCTGA ATCAGGTTCTTCCGAAAGCGGTTCTCTGAGGGCGGTCCAGGT CCTCCGAAAGCGGTTCTTCCGAGGGCGGTCCAGGTTCTTCTGAA AGCGGTTCTTCCGAGGGCGGTCCAGGTTCCTCTGAAAGCGGTTC TTCTGAGGGCGGTCCAGGTTCTTCCGAAAGCGGTTCTTCCGAGG GCGGTCCAGGTTCTTCCGAAAGCGGTTCTTCTGAAGGCGGTCCA GGTTCTGGTGGCGAACCGTCCGAGTCTGGTAGCTCAGGTGAAT | 718 |

TABLE 35-continued

Exemplary GHXTEN comprising growth hormones and single XTEN

| GHXTEN Name* | Amino Acid Sequence | SEQ ID NO: | DNA Nucleotide Sequence | SEQ ID NO: |
|---|---|---|---|---|
| | PGGSSGSESGSGGEP SESGSSGSEGSSGPG ESSGSSESGSSEGGP GSGGEPSESGSSGSE GSSGPGESSGSSESG SSEGGPGSGGEPSES GSSGESPGGSSGSES GSGGEPSESGSSGSG GEPSESGSGSSESGS SEGGPGSGGEPSESG SSGSGGEPSESGSSG SEGSSGPGESSGESP GGSSGSESGSEGSSG PGESSGSEGSSGPGE SSGSGGEPSESGSSG SSESGSSEGGPGSSES GSSEGGPGESPGGSS GSESGSGGEPSESGS SGSEGSSGPGESSGE SPGGSSGSESGSEGS SGPGSSESGSSEGGP GSGGEPSESGSSGSE GSSGPGESSGSEGSS GPGESSGSEGSSGPG ESSGSGGEPSESGSS GSGGEPSESGSSGES PGGSSGSESGSPGG SSGSESGSSGGEPSES GSSSGESGSSGGPGESS GESPGGSSGSESGES ESGSSEGGPGSSESG SSEGGPGSSGEPSESGSSE GGPGSGGEPSESGSS GSSESGSSEGGPGES PGGSSGSESGSGGEP SESGSSGSSESGSSEG GPGESPGGSSGSESG SGGEPSESGSSGESP GGSSGSESGSGGEPS ESGSS | | CTCCGGGTGGCTCTAGCGGTTCCGAGTCAGGTGAATCTCCTGGT GGTTCCAGCGGTTCCGAGTCAGGTTCCGGTGGCGAACCGTCCG AATCTGGTAGCTCAGGTAGCGAAGGTTCTTCTGGTCCAGGCGA ATCTTCAGGTTCCTCTGAAAGCGGTTCTTCTGAGGGCGGTCCAG GTTCCGGTGGCGAACCGTCCGAATCTGGTAGCTCAGGTAGCGA AGGTTCTTCTGGTCCAGGCGAATCTTCAGGTTCCTCTGAAAGCG GTTCTTCTGAGGGCGGTCCAGGTTCCGGTGGCGAACCTTCCGAA TCTGGTAGCTCAGGTGAATCTCCGGGTGGTTCTAGCGGTTCTGA GTCAGGTTCTGGTGGTGAACCTTCCGAGTCTGGTAGCTCAGGTT CTGGTGGCGAACCATCCGAGTCTGGTAGCTCAGGTTCTTCCGAA AGCGGTTCTTCCGAAGGCGGTCCAGGTTCTGGTGGTGAACCGTC CGAATCTGGTAGCTCAGGTTCTGGTGGCGAACCATCCGAATCTG GTAGCTCAGGTAGCGAAGGTTCTTCTGGTCCTGGCGAATCTTCA GGTGAATCTCCAGGTGGCTCTAGCGGTTCCGAATCAGGTAGCG AAGGTTCTTCCGGTCCAGGTGAATCTTCAGGTAGCGAAGGTTCT TCTGGTCCTGGTGAATCTTCAGGTAGCGAAGGTTCCGGTGGCGA ACCATCGGATCTGGTAGCTCAGGTAGCGAAGGTTCTTCTG GTCCTGGCGAATCTTCAGGTGAATCTCAGGTGGCTCTAGCGGT TCCGAATCAGGTAGCGAAGGTTCTTCCGGTCCAGGTTCCTCTGA AAGCGGTTCTTCTGAGGGCGGTCCAGGTTCTGGTGGCGAACCA TCTGAATCTGGTAGCTCAGGTAGCGAAGGTTCTTCCGGTCCGGG TGAATCTTCAGGTAGCGAAGGTTCTTCCGGTCCAGGTGAATCTT CAGGTAGCGAAGGTTCTTCTGGTCCTGGTGAATCCTCAGGTTCC GGTGGCGAACCATCTGAATCTGGTAGCTCAGGTTCTGGTGGCG AACCATCCGAATCTGGTAGCTCAGGTGAATCTCCGGGTGGTTC AGCGGTTCTGAATCAGGTGAATCTCCTGGTGGCTCCAGCGGTTC TGAGTCAGGTTCTGGTGGCGAACCATCCGAATCTGGTAGCTCA GGTAGCGAAGGTTCTTCTGGTCCTGGCGAATCTTCAGGTGAATC TCCAGGTGGCTCTAGCGGTTCCGAATCAGGTTCCTCTGAAAGCG GTTCTTCTGAGGGCGGTCCAGGTTCTTCTGAAAAGCGGTTCTTCC GAGGGCGGTCCAGGTTCTTCCGAAAGCGGTTCTTCTGAAGGCG GTCCAGGTTCTGGTGGCGAACCGTCCGAATCTGGTAGCTCAGGT TCCTCCGAAAGCGGTTCTTCTGAAGGTGGTCCAGGTGAATCTCC AGGTGGTTCTAGCGGTTCTGAATCAGGTTCTGGTGGCGAACCGT CCGAATCTGGTAGCTCAGGTTCCTCCGAAAAGCGGTTCTTCTGAA GGTGGTCCAGGTGAATCTCCAGGTGGTTCTAGCGGTTCTGAATC AGGTTCTGGTGGCGAACCGTCCGAATCTGGTAGCTCAGGTGAA TCTCCTGGTGGTTCCAGCGGTTCCGAGTCAGGTTCTGGTGGCGA ACCTTCCGAATCTGGTAGCTCA | |
| hGH-AE864 | FPTIPLSRLFDNAML RAHRLHQLAFDTYQ EFEEAYIPKEQKYSF LQNPQTSLCFSESIPT PSNREETQQKSNLEL LRISLLLIQSWLEPVQ FLRSVFANSLVYGAS DSNVYDLLKDLEEGI QTLMGRLEDGSPRT GQIFKQTYSKFDTNS HNDDALLKNYGLLY CFRKDMDKVETFLRI VQCRSVEGSCGFGG SPAGSPTSTEEGTSES ATPESGPGTSTEPSE GSAPGSPAGSPTSTE EGTSTEPSEGSAPGT STEPSEGSAPGTSES ATPESGPGSEPATSG SETPGSEPATSGSETP GSPAGSPTSTEEGTS ESATPESGPGTSTEPS EGSAPGTSTEPSEGS APGSPAGSPTSTEEG TSTEPSEGSAPGTSTE PSEGSAPGTSESATP ESGPGTSTEPSEGSA PGTSESATPESGPGS EPATSGSETPGTSTEP SEGSAPGTSTEPSEG SAPGTSESATPESGP GTSESATPESGPGSP | 719 | TTTCCGACTATTCCGCTGTCTCGTCTGTTTGATAATGCTATGCTG CGTGCGCACCGTCTGCACCAGCTGGCTTTTGATACTTACCAGGA ATTTGAAGAGCTACATTCCTAAAGAGCAGAAGTACTCTTTCC TGCAAAACCCACAGACTTCTCTCTGCTTCAGCGAATCTATTCCG ACGCCTTCCAATCGCGAGGAAACTCAGCAAAAGTCCAATCTGG AACTACTCCGCATTTCTCTGCTTCTGATTCAGAGCTGGCTAGAA CCAGTGCAATTTCTGCGTTCCGTCTTCGCCAATAGCCTAGTTTA TGGCGCATCCGACAGCAACGTATACGATCTCCTGAAAGATCTC GAGGAAGGCATTCAGACCCTGATGGGTCGTCTCGAGGATGGCT CTCCGCGTACTGGTCAGATCTTCAAGCAGACTTACTCTAAATTT GATACTAACAGCCACAATGACGATGCGCTTCTAAAAAACTATG GTCTGCTGTATTGTTTCGTAAAGATATGGACAAAGTTGAAACC TTCCTGCGTATTGTTCAGTGTCGTTCCGTTGAGGGCAGCTGTGG TTTCTAAGGTGGTAGCCCGGCTGGCTCTCCTACCTCTACTGAGG AAGGTACTTCTGAAAGCGCTACTCCTGAGTCTGGTCCAGGTACC TCTACTGAACCGTCCGAAGGTAGCGCTCCAGGTAGCCCAGCAG GCTCTCCGACTTCCACTGAGGAAGGTACTTCTACTGAACCTTCC GAAGGCAGCGCACCAGGTACCTCTACTGAACCTTCTGAGGGCA GCGCTCCAGGTACTTCTGAAAGCGCTACCCCAGAATCTGGCCC AGGTAGCGAACCGGCTACTTCTGGTTCTGAAACCCCAGGTAGC GAACCGGCTACCTCCGGTTCTGAAATCCAGGTAGCCCGGCAG GCTCTCCGACCTCTACTGAGGAAGGTACTTCTGAAAGCGCAAC CCCGGAGTCCGGCCCAGGTACCTCTACCGAACCGTCTGAGGGC AGCGCACCAGGTACTTCTACCGAACCGTCCGAGGGTAGCGCAC CAGGTAGCCCAGCAGGTTCTCCTACCTCCACCGAGGAAGGTAC TTCTACCGAACCGTCCGAGGGTAGCGCACCAGGTACCTCTACTG AACCTTCTGAGGGTAGCGCACCAGGTACCTCTGAAAGCGCTAC CCCGGAGTCCGGTCCAGGTACTTCTACTGAACCGTCCGAAGGT AGCGCACCAGGTACTTCTGAAAGCGCAACCCCTGAATCCGGTC CAGGTAGCGAACCGGCTACTTCTGGCTCTGAGACTCCAGGTACT TCTACCGAACCGTCCGAAGGTAGCGCACCAGGTACTTCTACTG AACCGTCTGAAGGTAGCGCACCAGGTACTTCTGAAAGCGCAAC | 720 |

TABLE 35-continued

Exemplary GHXTEN comprising growth hormones and single XTEN

| GHXTEN Name* | Amino Acid Sequence | SEQ ID NO: | DNA Nucleotide Sequence | SEQ ID NO: |
|---|---|---|---|---|
| | AGSPTSTEEGTSESA TPESGPGSEPATSGS ETPGTSESATPESGP GTSTEPSEGSAPGTS TEPSEGSAPGTSTEPS EGSAPGTSTEPSEGS APGTSTEPSEGSAPG TSTEPSEGSAPGSPA GSPTSTEEGTSTEPSE GSAPGTSESATPESG PGSEPATSGSETPGT SESATPESGPGSEPA TSGSETPGTSESATPE SGPGTSTEPSEGSAP GTSESATPESGPGSP AGSPTSTEEGSPAGS PTSTEEGSPAGSPTST EEGTSESATPESGPG TSTEPSEGSAPGTSES ATPESGPGSEPATSG SETPGTSESATPESGP GSEPATSGSETPGTS ESATPESGPGTSTEPS EGSAPGSPAGSPTST EEGTSESATPESGPG SEPATSGSETPGTSES ATPESGPGSPAGSPT STEEGSPAGSPTSTEE GTSTEPSEGSAPGTS ESATPESGPGTSESA TPESGPGTSESATPES GPGSEPATSGSETPG SEPATSGSETPGSPA GSPTSTEEGTSTEPSE GSAPGTSTEPSEGSA PGSEPATSGSETPGT SESATPESGPGTSTEP SEGSAP | | CCCGGAATCCGGCCCAGGTACCTCTGAAAGCGCAACCCCGGAG TCCGGCCCAGGTAGCCCTGCTGGCTCTCCAACCTCCACCGAAGA AGGTACCTCTGAAAGCGCAACCCCTGAATCCGGCCCAGGTAGC GAACCGGCAACCTCCGGTTCTGAAACCCCAGGTACCTCTGAAA GCGCTACTCCGGAGTCTGGCCCAGGTACCTCTACTGAACCGTCT GAGGGTAGCGCTCCAGGTACTTCTACTGAACCGTCCGAAGGTA GCGCACCAGGTACTTCTACCGAACCGTCCGAAGGCAGCGCTCC AGGTACCTCTACTGAACCTTCTGAGGGCAGCGCTCCAGGTACCT CTACCGAACCTTCTGAAGGTAGCGCACCAGGTACTTCTACCGA ACCGTCCGAGGGTAGCGCACCAGGTAGCCCAGCAGGTTCTCCT ACCTCCACCGAGGAAGGTACTTCTACCGAACCGTCCGAGGGTA GCGCACCAGGTACCTCTGAAAGCGCAACTCCTGAGTCTGGCCC AGGTAGCGAACCTGCTACCTCCGGCTCTGAGACTCCAGGTACCT CTGAAAGCGCAACCCCGGAATCTGGTCCAGGTAGCGAACCTGC AACCTCTGGCTCTGAAACCCCAGGTACCTCTGAAAGCGCTACTC CTGAATCTGGCCCAGGTACTTCTACTGAACCGTCCGAGGGCA CGCACCAGGTACTTCTGAAAGCGCTACTCCTGAGTCCGGCCCA GGTAGCCCGGCTGGCTCTCCGACTTCCACCGAGGAAGGTAGCC CGGCTGGCTCTCCAACTTCTACTGAAGAAGGTAGCCCGGCAGG CTCTCCGACCTCTACTGAGGAAGGTACTTCTGAAAGCGAACCC GGAGTCCGGCCCAGGTACCTCTACCGAACCGTCTGAGGGCAG CGCACCAGGTACCTCTGAAAGCGCAACTCCTGAGTCTGGCCCA GGTAGCGAACCTGCTACCTCCGGCTCTGAGACTCCAGGTACCTC TGAAAGCGCAACCCCGGAATCTGGTCCAGGTAGCGAACCTGCA ACCTCTGGCTCTGAAACCCCAGGTACCTCTGAAAGCGCTACTCC TGAATCTGGCCCAGGTACTTCTACTGAACCGTCCGAGGGCAGC GCACCAGGTAGCCCTGCTGGCTCTCCAACCTCCACCGAAGAAG GTACCTCTGAAAGCGCAACCCTGAATCCGGCCCAGGTAGCGA ACCGGCAACCTCCGGTTCTGAAACCCCAGGTACTTCTGAAAGC GCTACTCCTGAGTCCGGCCCAGGTAGCCCGGCTGGCTCTCCGAC TTCCACCGAGGAAGGTAGCCCGGCTGGCTCTCCAACTTCTACTG AAGAAGGTACTTCTACCGAACCTTCCGAGGGCAGCGCACCAGG TACTTCTGAAAGCGCTACCCCTGAGTCCGGCCCAGGTACTTCTG AAAGCGCTACTCCTGAATCCGGTCCAGGTACTTCTGAAAGCGCT ACCCCGGAATCTGGCCCAGGTAGCGAACCGGCTACTTCTGGTTC TGAAACCCCAGGTAGCGAACCGGCTACCTCCGGTTCTGAAACT CCAGGTAGCGAACCGGCTCTCCGACTTCCACTGAGGAAGTA CTTCTACTGAACCTTCCGAAGGCAGCGCACCAGGTACCTCTACT GAACCTTCTGAGGGCAGCGCTCCAGGTAGCGAACCTGCAACCT CTGGCTCTGAAACCCCAGGTACCTCTGAAAGCGCTACTCCTGAA TCTGGCCCAGGTACTTCTACTGAACCGTCCGAGGGCAGCGCAC CA | |
| hGH- AF864 | FPTIPLSRLFDNAML RAHRLHQLAFDTYQ EFEEAYIPKEQKYSF LQNPQTSLCFSESIPT PSNREETQQKSNLEL LRISLLLIQSWLEPVQ FLRSVFANSLVYGAS DSNVYDLLKDLEEGI QTLMGRLEDGSPRT GQIFKQTYSKFDTNS HNDDALLKNYGLLY CFRKDMDKVETFLRI VQCRSVEGSCGFGG STSESPSGTAPGTSPS GESSTAPGSTSESPSG TAPGSTSESPSGTAP GTSTPESGSASPGTS TPESGSASPGTSESP SGTAPGSTSESPSGT APGTSPSGESSTAPG STSESPSGTAPGTSPS GESSTAPGTSPSGESS TAPGSTSSTAESPGP GTSPSGESSTAPGTSP SGESSTAPGSTSSTA ESPGPGTSTPESGSAS PGTSTPESGSASPGST SESPSGTAPGSTSESP SGTAPGSTPESGSA SPGSTSSTAESPGPGT STPESGSASPGSTSES PSGTAPGTSPSGESST | 721 | TTTCCGACTATTCCGCTGTCTCGTCTGTTTGATAATGCTATGCTG CGTGCGCACCGTCTGCACCAGCTGGCTTTTGATACTTACCAGGA ATTTGAAGAAGCcTACATTCCTAAAGAGCAGAAGTACTTTTCC TGCAAAACCCACAGACTTCTCTCTGCTTCAGCGAATCTATTCCG ACGCCTTCCAATCGCGAGGAAACTCAGCAAAAGTCCAATCTGG AACTACTCCGCATTTCTCTGCTTCTGATTCAGAGCTGGCTAGAA CCAGTGCAATTTCTGCGTTCCGTCTTCGCCAATAGCCTAGTTTA TGGCGCATCCGACAGCAACGTATACGATCTCCTGAAAGATCTC GAGGAAGGCATTCAGACCCTGATGGGTCGTCTCGAGGATGGCT CTCCGCGTACTGGTCAGATCTTCAAGCAGACTTACTCTAAATTT GATACTAACAGCCACAATGACGATGCGCTTCTAAAAAACTATG GTCTGCTGTATTGTTTCGTAAAGATATGGACAAAGTTGAAACC TTCCTGCGTATTGTTCAGTGTCGTTCCGTTGAGGGCAGCTGTGG TTTCTAAGGTGGTTCTACCAGCGAATCTCCTTCTGGCACCGCTC CAGGTACCTCTCCTAGCGGCGAATCTTCTACCGCTCCAGGTTCT ACTAGCGAATCTCCTTCTGGCACTGCACCAGGTTCTACTAGCGA ATCCCCGTCTGGTACTGCTCCAGGTACTTCTACTCCTGAAAGCG GTTCCGCTTCTCCAGGTACCTCTACTCCGGAAAGCGGTTCTGCA TCTCCAGGTTCTACCAGCGAATCTCCTTCTGGCACCGCTCCAGG TTCTACTAGCGAATCCCCGTCTGGTACCGCACCAGGTACTTCTC CTAGCGGAATCTTCTACCGCACCAGGTTCTACTAGCGAATCT CCGTCTGGCACTGCTCCAGGTACTTCTCCTAGCGGTGAATCTTC TACCGCTCCAGGTACTTCTCCTAGCGGTGAATCTTCTACCGCTC CAGGTTCTACTAGCTCTACTGCAGAATCTCCTGGCCCAGGTACT TCTCCTAGCGGTGAATCTTCTACCGCTCCAGGTTCTACTAGCTCT ACTGCAGAATCTCCTGGCCCAGGTACTTCTACCCCTGAAAGCGG TTCTGCATCTCCAGGTACTTCTACCCCTGAAAGCGGTTCTGCAT CTCCAGGTTCTACTAGCGAATCCCCTTCTGGCACTGCACCAGGT TCTACCAGCGAATCTCCGTCTGGCACTGCACCAGGTACCTCTAC CCCTGAAAGCGGTTCCGCTTCTCCAGGTTCTACCAGCTCTACCG CAGAATCTCCTGGTCCAGGTACCTCTACTCCGGAAAGCGGCTCT GCATCTC | 722 |

TABLE 35-continued

Exemplary GHXTEN comprising growth hormones and single XTEN

| GHXTEN Name* | Amino Acid Sequence | SEQ ID NO: | DNA Nucleotide Sequence | SEQ ID NO: |
|---|---|---|---|---|
| | APGSTSSTAESPGPG<br>TSPSGESSTAPGTSTP<br>ESGSASPGSTSSTAES<br>PGPGSTSSTAESPGP<br>GSTSSTAESPGPGSTS<br>STAESPGPGTSPSGES<br>STAPGSTSESPSGTAP<br>GSTSESPSGTAPGTS<br>TPESGPXXXGASASG<br>APSTXXXXSESPSGT<br>APGSTSESPSGTAPG<br>STSESPSGTAPGSTSE<br>SPSGTAPGSTSESPSG<br>TAPGSTSESPSGTAP<br>GTSTPESGSASPGTSP<br>SGESSTAPGTSPSGES<br>STAPGSTSSTAESPGP<br>GTSPSGESSTAPGTS<br>TPESGSASPGSTSESP<br>SGTAPGSTSESPSGT<br>APGTSPSGESSTAPG<br>STSESPSGTAPGTSTP<br>ESGSASPGTSTPESGS<br>ASPGSTSESPSGTAP<br>GTSTPESGSASPGSTS<br>STAESPGPGSTSESPS<br>GTAPGSTSESPSGTA<br>PGTSPSGESSTAPGST<br>SSTAESPGPGTSPSGE<br>SSTAPGTSTPESGSAS<br>PGTSPSGESSTAPGTS<br>PSGESSTAPGTSPSGE<br>SSTAPGSTSSTAESPG<br>PGSTSSTAESPGPGTS<br>PSGESSTAPGSSPSAS<br>TGTGPGSSTPSGATG<br>SPGSSTPSGATGSP | | CAGGTTCTACTAGCGAATCTCCTTCTGGCACTGCACCAGGTACT<br>TCTCCGAGCGGTGAATCTTCTACCGCACCAGGTTCTACTAGCTC<br>TACCGCTGAATCTCCGGGCCCAGGTACTTCTCCGAGCGGTGAAT<br>CTTCTACTGCTCCAGGTACCTCTACTCCTGAAAGCGGTTCTGCA<br>TCTCCAGGTTCCACTAGCTCTACCGCAGAATCTCCGGGCCCAGG<br>TTCTACTAGCTCTACTGCTGAATCTCCTGGCCCAGGTTCTACTA<br>GCTCTACTGCTGAATCTCCGGGTCCAGGTTCTACCAGCTCTACT<br>GCTGAATCTCCTGGTCCAGGTACCTCCCCGAGCGGTGAATCTTC<br>TACTGCACCAGGTTCTACTAGCGAATCTCCTTCTGGCACTGCAC<br>CAGGTTCTACCAGCGAATCTCCGTCTGGCACTGCACCAGGTACC<br>TCTACCCCTGAAAGCGGTCCXXXXXXXXXXXXTGCAAGCGCAA<br>GCGGCGCGCCAAGCACGGGATXXXXXXXXTAGCGAATCTCCTTC<br>TGGTACCGCTCCAGGTTCTACCAGCGAATCCCCGTCTGGTACTG<br>CTCCAGGTTCTACCAGCGAATCTCCTTCTGGTACTGCACCAGGT<br>TCTACTAGCGAATCTCCTTCTGGTACCGCTCCAGGTTCTACCAG<br>CGAATCCCCGTCTGGTACTGCAGGTTCTACCAGCGAATCTC<br>CTTCTGGTACTGCACCAGGTACTTCTACTCCGGAAAGCGGTTCC<br>GCATCTCCAGGTACTTCTCCTAGCGGTGAATCTTCTACTGCTCC<br>AGGTACCTCTCCTAGCGGCGAATCTTCTACTGCTCCAGGTTCTA<br>CCAGCTCTACTGCTGAATCTCCGGGTCCAGGTACTTCCCCGAGC<br>GGTGAATCTTCTACTGCACCAGGTACTTCTACTCCGGAAAGCGG<br>TTCCGCTTCTCCAGGTTCTACCAGCGAATCTCCTTCTGGCACCG<br>CTCCAGGTTCTACTAGCGAATCCCCGTCTGGTACCGCACCAGGT<br>ACTTCTCCTAGCGGCGAATTTCTACCGCACCAGGTTCTACTAG<br>CGAATCCCCGTCTGGTACCGCACCAGGTACTTCTACCCCGGAAA<br>GCGGCTCTGCTTCTCCAGGTACTTCTACCCCGGAAAGCGGCTCC<br>GCATCTCCAGGTTCTACTAGCGAATCTCCTTCTGGTACCGCTCC<br>AGGTACTTCTACCCCTGAAAGCGGTCCGCTTCTCCAGGTTCCA<br>CTAGCTCTACCGCTGAATCTCCGGGTCCAGGTTCTACCAGCGAA<br>TCTCCTTCTGGCACCGCTCCAGGTTCTACTAGCGAATCCCCGTC<br>TGGTACCGCACCAGGTACTTCTCCTAGCGGCGAATCTTCTACCG<br>CACCAGGTTCTACCAGCTCTACTGCTGAATCTCCGGGTCCAGGT<br>ACTTCCCCGAGCGGTGAATCTTCTACTGCACCAGGTACTTCTAC<br>TCCGGAAAGCGGTTCCGCTTCTCCAGGTACCTCCCCTAGCGCG<br>AATCTTCTACTGCTCCAGGTACCTCTCCTAGCGGCGAATCTTCT<br>ACCGCTCCAGGTACCTCCCCTAGCGGTGAATCTTCTACCGCACC<br>AGGTTCTACTAGCTCTACTGCTGAATCTCCGGGTCCAGGTTCTA<br>CCAGCTCTACTGCTGAATCTCCTGGTCAGGTACCTCCCCGAGC<br>GGTGAATCTTCTACTGCACCAGGTTCTAGCCCTTCTGCTTCCAC<br>CGGTACCGGCCCAGGTAGCTCTACTCCGTCTGGTGCAACTGGCT<br>CTCCAGGTAGCTCTACTCCGTCTGGTGCAACCGGCTCCCCA | |
| hGH-<br>AG864 | FPTIPLSRLFDNAML<br>RAHRLHQLAFDTYQ<br>EFEEAYIPKEQKYSF<br>LQNPQTSLCFSESIPT<br>PSNREETQQKSNLEL<br>LRISLLLIQSWLEPVQ<br>FLRSVFANSLVYGAS<br>DSNVYDLLKDLEEGI<br>QTLMGRLEDGSPRT<br>GQIFKQTYSKFDTNS<br>HNDDALLKNYGLLY<br>CFRKDMDKVETFLRI<br>VQCRSVEGSCGFGG<br>ASPGTSSTGSPGSSPS<br>ASTGTGPGSSPSAST<br>GTGPGTPGSGTASSS<br>PGSSTPSGATGSPGS<br>NPSASTGTGPGASPG<br>TSSTGSPGTPGSGTA<br>SSSPGSSTPSGATGSP<br>GTPGSGTASSSPGAS<br>PGTSSTGSPGASPGT<br>SSTGSPGTPGSGTAS<br>SSPGSSTPSGATGSP<br>GASPGTSSTGSPGTP<br>GSGTASSSPGSSTPS<br>GATGSPGSNPSASTG<br>TGPGSSPSASTGTGP<br>GSSTPSGATGSPGSS<br>TPSGATGSPGASPGT<br>SSTGSPGASPGTSST<br>GSPGASPGTSSTGSP<br>GTPGSGTASSSPGAS | 723 | TTTCCGACTATTCCGCTGTCTCGTCTGTTTGATAATGCTATGCTG<br>CGTGCGCACCGTCTGCACCAGCTGGCCTTTGATACTTACCAGGA<br>ATTTGAAGAAGCcTACATTCCTAAAGAGCAGAAGTACTCTTTCC<br>TGCAAAACCCACAGACTTCTCTCTGCTTCAGCGAATCTATTCCG<br>ACGCCTTCCAATGCGAGGAAACTCAGCAAAGTCCAATCTGG<br>AACTACTCCGCATTTCTCTGCTTCTGATTCAGAGCTGGCTAGAA<br>CCAGTGCAATTTCTGCGTTCCGTCTTCGCCAATAGCCTAGTTTA<br>TGGCGCATCCGACAGCAACGTATACGATCTCCTGAAAGATCTC<br>GAGGAAGGCATTCAGACCCTGATGGGTCGTCTCGAGGATGGCT<br>CTCCGCGTACTGGTCAGATCTTCAAGCAGACTTACTCTAAATTT<br>GATACTAACAGCCACAATGACGATGCGCTTCTAAAAACTATG<br>GTCTGCTGTATTGTTTTCGTAAAGATATGGACAAAGTTGAAACC<br>TTCCTGCGTATTGTTCAGTGTCGTTCCGTTGAGGGCAGCTGTGG<br>TTTTCTAAGGTGGTGCTTCCCCGGGCACCAGCTCTACTGGTTCTC<br>CAGGTTCTAGCCCGTCTGCTTCTACTGGTACTGGTCCAGGTTCT<br>AGCCCTTCTGCTTCCACTGGTACTGGTCCAGGTACCCCGGGTAG<br>CGGTACCGCTTCTTCTTCTCCAGGTAGCTCTACTCCGTCTGGTGC<br>TACCGGCTCTCCAGGTTCTAACCCTTCTGCATCCACCGGTACCG<br>GCCCAGGTGCTTCTCCGGGCACCAGCTCTACTGGTTCTCCAGGT<br>ACCCCGGGCAGCGGTACCGCATCTTCTCCAGGTAGCTCTAC<br>CCCTTCTGGTGCAACTGGTTCTCCAGGTACTCCTGGCAGCGGTA<br>CCGTTCTTCTTCTCCAGGTGCTTCTCCTGGTACTAGCTCTACTG<br>GTTCTCCAGGTGCTTCTCCGGGCACTAGCTCTACTGGTTCTCCA<br>GGTACCCCGGGTAGCGGTACTGCTTCTTCCTCTCCAGGTAGCTC<br>TACCCCTTCTGGTGCAACGGCTCTCCAGGTGCTTCTCCGGGCA<br>CCAGCTCTACCGGTTCTCCAGGTACCCCGGGTAGCGGTACCGCT<br>TCTTCTTCTCCAGGTAGCTCTACTCCGTCTGGTGCTACCGGCTCT<br>CCAGGTTCTAACCCTTCTGCATCCACCGGTACCGGCCCAGGTTC<br>TAGCCCTTCTGCTTCCACCGGTACTGGCCCAGGTAGCTCTACCC<br>CTTCTGGTGCTACCGGCTCCCCAGGTAGCTCTACTCCTTCTGGT<br>GCAACTGGCTCTCCAGGTGCATCTCCGGGCACTAGCTCTACTGG<br>TTCTCCAGGTGCATCCCTGGCACTAGCTCTACTGGTTCTCCAG<br>GCTTCTCCTGGTACCAGCTCTACTGGTTCTCCAGGTACTCCT | 724 |

TABLE 35-continued

Exemplary GHXTEN comprising growth hormones and single XTEN

| GHXTEN Name* | Amino Acid Sequence | SEQ ID NO: | DNA Nucleotide Sequence | SEQ ID NO: |
|---|---|---|---|---|
| | PGTSSTGSPGASPGT SSTGSPGASPGTSST GSPGSSPSASTGTGP GTPGSGTASSSPGAS PGTSSTGSPGASPGT SSTGSPGASPGTSST GSPGSSTPSGATGSP GSSTPSGATGSPGAS PGTSSTGSPGTPGSG TASSSPGSSTPSGAT GSPGSSTPSGATGSP GSSTPSGATGSPGSS PSASTGTGPGASPGT SSTGSPGASPGTSST GSPGTPGSGTASSSP GASPGTSSTGSPGAS PGTSSTGSPGASPGT SSTGSPGASPGTSST GSPGTPGSGTASSSP GSSTPSGATGSPGTP GSGTASSSPGSSTPS GATGSPGTPGSGTAS SSPGSSTPSGATGSP GSSTPSGATGSPGSS PSASTGTGPGSSPSA STGTGPGASPGTSST GSPGTPGSGTASSSP GSSTPSGATGSPGSS PSASTGTGPGSSPSA STGTGPGASPGTSST GSPGASPGTSSTGSP GSSTPSGATGSPGSS PSASTGTGPGASPGT SSTGSPGSSPSASTGT GPGTPGSGTASSSPG SSTPSGATGSPGSSTP SGATGSPGASPGTSS TGSP | | GGCAGCGGTACCGCTTCTTCTTCTCCAGGTGCTTCTCCTGGTAC TAGCTCTACTGGTTCTCCAGGTGCTTCTCCGGGCACTAGCTCTA CTGGTTCTCCAGGTGCTTCCCCGGGCACTAGCTCTACCGGTTCT CCAGGTTCTAGCCCTTCTGCATCTACTGGTACTGGCCCAGGTAC TCCGGGCAGCGGTACTGCTTCTTCCTCTCCAGGTGCATCTCCGG GCACTAGCTCTACTGGTTCTCCAGGTGCATCCCTGGCACTAGC TCTACTGGTTCTCCAGGTGCTTCTCCTGGTACCAGCTCTACTGGT TCTCCAGGTAGCTCTACTCCGTCTGGTGCAACCGGTTCCCCAGG TAGCTCTACTCCTTCTGGTGCTACTGGCTCCCCAGGTGCATCCC CTGGCACCAGCTCTACCGGTTCTCCAGGTACCCCGGGCAGCGGT ACCGCATCTTCCTCTCCAGGTAGCTCTACCCCGTCTGGTGCTAC CGGTTCCCCAGGTAGCTCTACCCCGTCTGGTGCAACCGGCTCC CAGGTAGCTCTACTCCGTCTGGTGCAACCGGCTCCCCAGGTTCT AGCCCGTCTGCTTCCACTGGTACTGGCCCAGGTGCTTCCCGGG CACCAGCTCTACTGGTTCTCCAGGTGCATCCCGGGTACCAGCT CTACCGGTTCTCCAGGTACTCCTGGCAGCGGTACTGCATCTTCC TCTCCAGGTGCTTCTCCGGGCACCAGCTCTACTGGTTCTCCAGG TGCATCTCCGGGCACTAGCTCTACTGGTTCTCCAGGTGCATCCC CTGGCACTAGCTCTACTGGTTCTCCAGGTGCTTCTCCTGGTACC AGCTCTACTGGTTCTCCAGGTACCCCTGGTAGCGGTACTGCTTC TTCCTCTCCAGGTAGCTCTACTCCGTCTGGTGCTACCGGTTCTCC AGGTACCCCGGGTAGCGGTACCGCATCTTCTTCTCCAGGTAGCT CTACCCCGTCTGGTGCTACTGGTTCTCCAGGTACTCCGGGCAGC GGTACTGCTTCTTCCTCTCCAGGTAGCTCTACCCCTTCTGGTGCT ACTGGCTCTCCAGGTAGCTCTACCCCGTCTGGTGCTACTGGCTC CCCAGGTTCTAGCCCTTCTGCATCCACCGGTACCGGTCCAGGTT CTAGCCCGTCTGCATCTACTGGTACTGGTCCAGGTGCATCCCG GGCACTAGCTCTACCGGTTCTCCAGGTACTCCTGGTAGCGGTAC CGGGTACTAGCTCTACTGGTTCTCCAGGTGCATCTCCTGGTAC CCGGGTACTAGCTCTACTGGTTCTCCAGGTGCATCTCCTGGTAC TAGCTCTACTGGTTCTCCAGGTGCTCTACCGTCTGGTGCAA CCGGCTCTCCAGGTTCTAGCCCTTCTGCATCTACCGGTACTGGT CCAGGTGCATCCCTGGTACCAGCTCTACCGGTTCTCCAGGTTC TAGCCCTTCTGCTTCTACCGGTACCGGTCCAGGTACCCCTGGCA GCGGTACCGCATCTTCCTCTCCAGGTAGCTCTACTCCGTCTGGT GCAACCGGTTCCCCAGGTAGCTCTACTCCTTCTGGTGCTACTGG CTCCCCAGGTGCATCCCTGGCACCAGCTCTACCGGTTCTCCA | |
| hGH-AM875 | FPTIPLSRLFDNAML RAHRLHQLAFDTYQ EFEEAYIPKEQKYSF LQNPQTSLCFSESIPT PSNREETQQKSNLEL LRISLLLIQSWLEPVQ FLRSVFANSLVYGAS DSNVYDLLKDLEEGI QTLMGRLEDGSPRT GQIFKQTYSKFDTNS HNDDALLKNYGLLY CFRKDMDKVETFLRI VQCRSVEGSCGFGG TSTEPSEGSAPGSEP ATSGSETPGSPAGSP TSTEEGSTSSTAESPG PGTSTPESGSASPGST SESPSGTAPGSTSESP SGTAPGTSTPESGSA SPGTSTPESGSASPGS EPATSGSETPGTSES ATPESGPGSPAGSPT STEEGTSTEPSEGSAP GTSESATPESGPGTS TEPSEGSAPGTSTEPS EGSAPGSPAGSPTST EEGTSTEPSEGSAPG TSTEPSEGSAPGTSES ATPESGPGTSESATP ESGPGTSTEPSEGSA PGTSTEPSEGSAPGT SESATPESGPGTSTEP SEGSAPGSEPATSGS ETPGSPAGSPTSTEE GSSTPSGATGSPGTP | 725 | TTTCCGACTATTCCGCTGTCTCGTCTGTTTGATAATGCTATGCTG CGTGCGCACCGTCTGCACCAGCTGGCCTTTGATACTTACCAGGA ATTTGAAGAAGCTACATTCCTAAAGAGCAGAAGTACTCTTTCC TGCAAAACCCACAGACTTCTCTCTGCTTCAGCGAATCTATTCCG ACGCCTTCCAATGCGAGGAAACTCAGCAAAAGTCCAATCTGG AACTACTCCGCATTTCTCTGCTTCTGATTCAGAGCTGGCTAGAA CCAGTGCAATTTCTGCGTTCCGTCTTCGCCAATAGCCTAGTTTA TGGCGCATCCGACAGCAACGTATACGATCTCCTGAAAGATCTC GAGGAAGGCATTCAGACCCTGATGGGTCGTCTCGAGGATGGCT CTCCGCGTACTGGTCAGATCTTCAAGCAGACTTACTCTAAATTT GATACTAACAGCCACAATGACGATGCGCTTCTAAAAAACTATG GTCTGCTGTATTGTTTTCGTAAAGATATGGACAAAGTTGAAACC TTCCTGCGTATTGTTCAGTGTCGTTCCGTTGAGGGCAGCTGTGG TTTCTAAGGTGGTACTTCTACTGAACCGTCTGAAGGCAGCGCAC CAGGTAGCGAACCGGCTACTTCCGGTTCTGAAACCCCAGGTAG CCCAGCAGGTTCTCCAACTTCTACTGAAGAAGGTTCTACCAGCT CTACCGCAGAATCTCCTGGTCCAGGTACCTCTACTCCGGAAAGC GGCTCTGCATCTCCAGGTTCTACTAGCGAATCTCCTTCTGGCAC TGCACCAGGTTCTACTAGCGAATCCCCGTCTGGTACTGCTCCAG GTACTTCTACTCCTGAAAGCGGTTCCGCTTCTCCAGGTACCTCT ACTCCGGAAAGCGGTTCTGCATCTCCAGGTAGCGAACCGGCAA CCTCCGGCTCTGAAACCCCAGGTACCTCTGAAAGCGCTACTCCT GAATCCGGCCCAGGTAGCCCGGCAGGTTCTCCGACTTCCACTG AGGAAGGTACCTCTACTGAACCTTCTGAGGGCAGCGCTCCAGG TACTTCTGAAAGCGCTACCCCGGAGTCCGGTCCAGGTACTTCTA CTGAACCGTCTGAAGGCAGCGCACCAGGTACTTCTACCGAACC GTCCGAGGGTAGCGCACCAGGTAGCCCAGCAGGTTCTCCTACC TCCACCGAGGAAGGTACTTCTACCGAACCGTCCGAGGGTAGCG CACCAGGTACTTCTACCGAACCTTCCGAGGGCAGCGCACCAGG TACTTCTGAAAGCGCTACCCCTGAGTCCGGCCCAGGTACTTCTG AAAGCGCTACTCCTGAATCCGGTCCAGGTACCTCTACTGAACCT TCCGAAGGCAGCGCTCCAGGTACCTCTACCGAACCGTCCGAGG GCAGCGCACCAGGTACTTCTGAAAGCGCAACCCCTGAATCCGG TCCAGGTACTTCTACTGAACCTTCCGAAGGTAGCGCTCCAGGTA GCGAACCTGCTACTTCTGGTTCTGAAACCCCAGGTAGCCCGGCT | 726 |

TABLE 35-continued

Exemplary GHXTEN comprising growth hormones and single XTEN

| GHXTEN Name* | Amino Acid Sequence | SEQ ID NO: | DNA Nucleotide Sequence | SEQ ID NO: |
|---|---|---|---|---|
| | GSGTASSSPGSSTPS GATGSPGTSTEPSEG SAPGTSTEPSEGSAP GSEPATSGSETPGSP AGSPTSTEEGSPAGS PTSTEEGTSTEPSEGS APGASASGAPSTGGT SESATPESGPGSPAG SPTSTEEGSPAGSPTS TEEGSTSSTAESPGP GSTSESPSGTAPGTSP SGESSTAPGTPGSGT ASSSPGSSTPSGATG SPGSSPSASTGTGPG SEPATSGSETPGTSES ATPESGPGSEPATSG SETPGSTSSTAESPGP GSTSSTAESPGPGTSP SGESSTAPGSEPATS GSETPGSEPATSGSE TPGTSTEPSEGSAPG STSSTAESPGPGTSTP ESGSASPGSTSESPSG TAPGTSTEPSEGSAP GTSTEPSEGSAPGTS TEPSEGSAPGSSTPSG ATGSPGSSPSASTGT GPGASPGTSSTGSPG SEPATSGSETPGTSES ATPESGPGSPAGSPT STEEGSSTPSGATGS PGSSPSASTGTGPGA SPGTSSTGSPGTSESA TPESGPGTSTEPSEGS APGTSTEPSEGSAP | | GGCTCTCCGACCTCCACCGAGGAAGGTAGCTCTACCCCGTCTGG TGCTACTGGTTCTCCAGGTACTCCGGGCAGCGGTACTGCTTCTT CCTCTCCAGGTAGCTCTACCCCTTCTGGTGCTACTGGCTCTCCA GGTACCTCTACCGAACCTCCGAGGGTAGCGCACCAGGTACCT CTACTGAACCGTCTGAGGGTAGCGCTCCAGGTAGCGAACCGGC AACCTCCGGTTCTGAAACTCCAGGTAGCCCTGCTGGCTCTCCGA CTTCTACTGAGGAAGGTAGCCCGGCTGGTTCTCCGACTTCTACT GAGGAAGGTACTTCTACCGAACCTTCCGAAGGTAGCGCTCCAG GTGCAAGCGCAAGCGGCGCGCCAAGCAGGGAGGTACTTCTGA AAGCGCTACTCCTGAGTCCGGCCCAGGTAGCCCGGCTGGCTCTC CGACTTCCACCGAGGAAGGTAGCCCGGCTGGCTCTCCAACTTCT ACTGAAGAAGGTTCTACCAGCTCTACCGCTGAATCTCCTGGCCC AGGTTCTACTAGCGAATCTCCTGCACCGCACCAGGTACTT CCCCTAGCGGTGAATCTTCTACTGCACCAGGTACCCCTGGCAGC GGTACCGCTTCTTCCTCTCCAGGTAGCTCTACCCCGTCTGGTGC TACTGGCTCTCCAGGTTCTAGCCCCGTCTGCATCTACCGGTACCG GCCCAGGTAGCGAACCGGCAACCTCCGGCTCTGAAACTCCAGG TACTTCTGAAAGCGCTACTCCGAATCCGGCCCAGGTAGCGAA CCGGCTACTTCCGGCTCTGAAACCCCAGGTTCCACCAGCTCTAC TGCAGAATCTCCGGGCCCAGGTTCTACTAGCTCTACTGCAGAAT CTCCGGGTCCAGGTACTTCTCCTAGCGGCGAATCTTCTACCGCT CCAGGTAGCGAACCGGCAACCTCTGGCTCTGAAACTCCAGGTA GCGAACCTGCAACCTCCGGCTCTGAAACCCCAGGTACTTCTACT GAACCTTCTGAGGGCAGCGCACCAGGTTCTACCAGCTCTACCG CAGAATCTCCTGGTCCAGGTACCTCTACTCCGGAAAGCGGCTCT GCATCTCCAGGTTCTACTAGCGAATCTCCTTCTGGCACTGCACC AGGTACTTCTACCGAACCGTCCGAAGGCAGCGCTCCAGGTACC TCTACTGAACCTTCCGAGGGCAGCCTCCAGGTACCTCTACCGA ACCTTCTGAAGGTAGCGCACCAGGTAGCTCTACTCCGTCTGGTG CAACCGGCTCCCCAGGTTCTAGCCCCGTCTGCTTCCACTGGTACT GGCCCAGGTGCTTCCCCGGGCACCAGCTCTACTGGTTCTCCAGG TAGCGAACCTGCTACCTCCGGTTCTGAAACCCAGGTACCTCTG AAAGCGCAACTCCGGAGTCTGGTCCAGGTAGCCCTGCAGGTTC TCCTACCTCCACTGAGGAAGGTAGCTCTACTCCGTCTGGTCAA CCGGCTCCCCAGGTTCTAGCCCCGTCTGCTTCCACTGGTACTGGC CCAGGTGCTTCCCCGGGCACCAGCTCTACTGGTTCTCCAGGTAC TCTGAAAGCGCTACTCCGGAGTCTGGCCCAGGTACCTCTACTG AACCGTCTGAGGGTAGCGCTCCAGGTACTTCTACTGAACCGTCC GAAGGTAGCGCACCA | |
| hGH-AM1318 | FPTIPLSRLFDNAML RAHRLHQLAFDTYQ EFEEAYIPKEQKYSF LQNPQTSLCFSESIPT PSNREETQQKSNLEL LRISLLLIQSWLEPVQ FLRSVFANSLVYGAS DSNVYDLLKDLEEGI QTLMGRLEDGSPRT GQIFKQTYSKFDTNS HNDDALLKNYGLLY CFRKDMDKVETFLRI VQCRSVEGSCGFGG TSTEPSEGSAPGSEP ATSGSETPGSPAGSP TSTEEGSTSSTAESPG PGTSTPESGSASPGST SESPSGTAPGSTSESP SGTAPGTSTPESGSA SPGTSTPESGSASPGS EPATSGSETPGTSES ATPESGPGSPAGSPT STEEGTSTEPSEGSAP GTSESATPESGPGTS TEPSEGSAPGTSTEPS EGSAPGSPAGSPTST EEGTSTEPSEGSAPG TSTEPSEGSAPGTSES ATPESGPGTSESATP ESGPGTSTEP SEGSAPGSEPATSGS ETPGSPAGSPTSTEE GTSTEPSEGSAPGT SESATPESGPGTSTEP SEGSAPGSEPATSGS ETPGSPAGSPTSTEE | 727 | TTTCCGACTATTCCGCTGTCTCGTCTGTTTGATAATGCTATGCTG CGTGCGCACCGTCTGCACCAGCTGGCCTTTGATACTTACCAGGA ATTTGAAGAAGCTACATTCCTAAAGAGCAGAAGTACTCTTTCC TGCAAAACCCACAGACTTCTCTCTGCTTCAGCGAATCTATTCCG ACGCCTTCCAATCGCGAGGAAACTCAGCAAAAGTCCAATCTGG AACTACTCCGCATTTCTCTGCTTCTGATTCAGAGCTGGCTAGAA CCAGTGCAATTTCTGCGTTCCGTCTTCGCCAATAGCCTAGTTA TGGCGCATCCGACAGCAACGTATACGATCTCCTGAAAGATCTC GAGGAAGGCATTCAGACCCTGATGGGTCGTCTCGAGGATGGCT CTCCGCGTACTGGTCAGATCTTCAAGCAGACTTACTCTAAATTT GATACTAACAGCCACAATGACGATGCGCTTCTAAAAAACTATG GTCTGCTGTATTGTTTCGTAAAGATATGGACAAAGTTGAAACC TTCCTGCGTATTGTTCAGTGCGTTCCGTTGAGGGCAGCTGTGG TTTCTAAGGTGGTACTTCTACTGAACCGTCTGAAGGCAGCGCAC CAGGTAGCGAACCGGCTACTTCCGGTTCTGAAACCCCAGGTAG CCCAGCAGGTTCTCCAACTTCTACTGAAGAAGGTTCTACCAGCT CTACCGCAGAATCTCCTGGTCCAGGTACCTCTACTCCGGAAAGC GGCTCTGCATCTCCAGGTTCTACTAGCGAATCTCCTTCTGGCAC TGCACCAGGTTCTACTAGCGAATCCCCGTCTGGTACTGCTCCAG GTACTTCTACTCCTGAAAGCGGTTCCGCTTCTCCAGGTACCTCT ACTCCGGAAAGCGGTTCTGCATCTCCAGGTAGCGAACCGGCAA CCTCCGGCTCTGAAACCCCAGGTACTTCTGAAAGCGCTACTCCT GAATCCGGCCCAGGTAGCCCGGCAGGTTCTCCGACTTCCACTG AGGAAGGTACCTCTACTGAACCTTCTGAGGGCAGCGCTCCAGG TACTTCTGAAAGCGCTACCCCGGAGTCCGGTCCAGGTACTTCTA CTGAACCGTCCGAAGGCAGCGCACCAGGTACTTCTACCGAACC GTCCGAGGGTAGCGCACCAGGTAGCCCAGCAGGTTCTCCTACC TCCACCGAGGAAGGTACTTCTACCGAACCGTCCGAGGGTAGCG CACCAGGTACTTCTACCGAACCTTCCGAGGGCAGCGCACCAGG TACTTCTGAAAGCGCTACCCCTGAGTCCGGCCCAGGTACTTCTG AAAGCGCTACTCCGGAGTCCGGTCCAGGTACCTCTACTGAACCT TCCGAAGGCAGCGCTCCAGGTACCTCTACCGAACCGTCCGAGG GCAGCGCACCAGGTACTTCTGAAAGCGCTAACCCCTGAATCCGG TCCAGGTACTTCTACTGAACCTTCCGAAGGTAGCGCTCCAGGTA GCGAACCTGCTACTTCTGGTTCTGAAACCCAGGTAGCCCGGCT | 728 |

TABLE 35-continued

Exemplary GHXTEN comprising growth hormones and single XTEN

| GHXTEN Name* | Amino Acid Sequence | SEQ ID NO: | DNA Nucleotide Sequence | SEQ ID NO: |
|---|---|---|---|---|
| | GSGTASSSPGSSTPS | | GGCTCTCCGACCTCCACCGAGGAAGGTAGCTCTACCCCGTCTGG | |
| | GATGSPGTSTEPSEG | | TGCTACTGGTTCTCCAGGTACTCCGGGCAGCGGTACTGCTTCTT | |
| | SAPGTSTEPSEGSAP | | CCTCTCCAGGTAGCTCTACCCCTTCTGGTGCTACTGGCTCTCCA | |
| | GSEPATSGSETPGSP | | GGTACCTCTACCGAACCGTCCGAGGGTAGCGCACCAGGTACCT | |
| | AGSPTSTEEGSPAGS | | CTACTGAACCGTCTGAGGGTAGCGCTCCAGGTAGCGAACCGGC | |
| | PTSTEEGTSTEPSEGS | | AACCTCCGGTTCTGAAACTCCAGGTAGCCCTGCTGGCTCTCCGA | |
| | APGPEPTGPAPSGGS | | CTTCTACTGAGGAAGGTAGCCCGGCTGGTTCTCCGACTTCTACT | |
| | EPATSGSETPGTSES | | GAGGAAGGTACTTCTACCGAACCTTCCGAAGGTAGCGCTCCAG | |
| | ATPESGPGSPAGSPT | | GTCCAGAACCAACGGGGCCGGCCCCAAGCGGAGGTAGCGAAC | |
| | STEEGTSESATPESGP | | CGGCAACCTCCGGCTCTGAAACCCCAGGTACCTCTGAAAGCGC | |
| | GSPAGSPTSTEEGSP | | TACTCCTGAATCCGGCCCAGGTAGCCCCGGCAGGTTCTCCGACTT | |
| | AGSPTSTEEGTSESA | | CCACTGAGGAAGGTACTTCTGAAAGCGCTACTCCTGAGTCCGG | |
| | TPESGPGSPAGSPTST | | CCCAGGTAGCCCTGGCTCTCCGACTTCCACCGAGGAAGGT | |
| | EEGSPAGSPTSTEEG | | AGCCCGGCTGGCTCTCCAACTTCTACTGAAGAAGGTACTTCTGA | |
| | STSSTAESPGPGSTSE | | AAGCGCTACTCCTGAGTCCGGCCCAGGTAGCCCGGCTGGCTCTC | |
| | SPSGTAPGTSPSGESS | | CGACTTCCACCGAGGAAGGTAGCCCGGCTGGCTCTCCAACTTCT | |
| | TAPGSTSESPSGTAP | | ACTGAAGAAGGTTCTACCAGCTCTACCGCTGAATCTCCTGGCCC | |
| | GSTSESPSGTAPGTSP | | AGGTTCTACTAGCGAATCTCCGTCTGGCACCGCCACCAGGTACTT | |
| | SGESSTAPGTSTEPSE | | CCCCTAGCGGTGAATCTTCTACTGCACCAGGTTCTACCAGCGAA | |
| | GSAPGTSESATPESG | | TCTCCTTCTGGCACCGCTCCAGGTTCTACTAGCGAATCCCCGTC | |
| | PGTSESATPESGPGS | | TGGTACCGCACCAGGTACTTCTCCTAGCGGCGAATCTTCTACCG | |
| | EPATSGSETPGTSES | | CACCAGGTACTTCTACCGAACCTTCCGAGGGCAGCGCACCAGG | |
| | ATPESGPGTSESATP | | TACTTCTGAAAGCGCTACCCCTGAGTCCGGCCCAGGTACTTCTG | |
| | ESGPGTSTEPSEGSA | | AAAGCGCTACTCCTGAATCCGGTCCAGGTAGCGAACCGGCAAC | |
| | PGTSESATPESGPGT | | CTCTGGCTCTGAAACCCCAGGTACCTCTGAAAGCGCTACTCCGG | |
| | STEPSEGSAPGTSPSG | | AATCTGGTCCAGGTACTTCTGAAAGCGCTACTCCGGAATCCGGT | |
| | ESSTAPGTSPSGESST | | CCAGGTACCTCTACTGAACCTTCTGAGGGCAGCGCTCCAGGTAC | |
| | APGTSPSGESSTAPG | | TTCTGAAAGCGCTACCCCGGAGTCCGGTCCAGGTACTTCTACTG | |
| | TSTEPSEGSAPGSPA | | AACCGTCCGAAGGTAGCGCACCAGGTACCTCCCCTAGCGGCGA | |
| | GSPTSTEEGTSTEPSE | | ATCTTCTACTGCTCCAGGTACCTCTCCTAGCGGCGAATCTTCTA | |
| | GSAPGSSPSASTGTG | | CCGCTCCAGGTACCTCCCCTAGCGGTGAATCTTCTACCGCACCA | |
| | PGSSTPSGATGSPGS | | GGTACTTCTACCGAACCGTCCGAGGGTAGCGCACCAGGTAGCC | |
| | STPSGATGSPGSSTPS | | CAGCAGGTTCTCCTACCTCCACCGAGGAAGGTACTTCTACCGAA | |
| | GATGSPGSSTPSGAT | | CCGTCCGAGGGTAGCGCACCAGGTTCTAGCCCTTCTGCTTCCAC | |
| | GSPGASPGTSSTGSP | | CGGTACCGGCCCAGGTAGCTCTACTCCGTCTGGTGCAACTGGCT | |
| | GASASGAPSTGGTSP | | CTCCAGGTAGCTCTACTCCGTCTGGTGCAACCGGCTCCCCAGGT | |
| | SGESSTAPGSTSSTA | | AGCTCTACCCCGTCTGGTGCTACCGGCTCTCCAGGTAGCTCTAC | |
| | ESPGPGTSPSGESSTA | | CCCGTCTGGTGCAACCGGCTCCCCAGGTGCATCCCCGGGTACTA | |
| | PGTSESATPESGPGT | | GCTCTACCGGTTCTCCAGGTCAAGCGCAAGCGGCGCGCAAG | |
| | STEPSEGSAPGTSTEP | | CACGGGAGGTACTTCTCCGAGCGGTGAATCTTCTACCGCACCA | |
| | SEGSAPGSSPSASTG | | GGTTCTACTAGCTCTACCGCTGAATCTCCGGGCCCAGGTACTTC | |
| | TGPGSSTPSGATGSP | | TCCAGCGGTGAATCTTCTACTGCTCCAGGTACCTCTGAAAGCG | |
| | GASPGTSSTGSPGTS | | CTACTCCGGAGTCTGGCCCAGGTACCTCTACTGAACCGTCTGAG | |
| | TPESGSASPGTSPSGE | | GGTAGCGCTCCAGGTACTTCTGAACCGTCCGAAGGTAGCG | |
| | SSTAPGTSPSGESSTA | | CACCAGGTTCTAGCCCTTCTGCATCTACTGGTACTGGCCCAGGT | |
| | PGTSESATPESGPGS | | AGCTACTCCTTCTGGTGCTACCGGCTCTCCAGGTGCTTCTCC | |
| | EPATSGSETPGTSTEP | | GGGTACTAGCTCTACCGGTTCTCCAGGTACTTCTACTCCGGAAA | |
| | SEGSAPGSTSESPSGT | | GCGGTTCCGCATCTCCAGGTACTTCTCCTAGCGGTGAATCTTCT | |
| | APGSTSESPSGTAPG | | ACTGCTCCAGGTACCTCTCCTAGCGGCGAATCTTCTACTGCTCC | |
| | TSTPESGSASPGSPA | | AGGTACTTCTGAAAGCGCAACCCCTGAATCCGGTCCAGGTAGC | |
| | GSPTSTEEGTSESATP | | GAACCGGCTACTTCTGGCTCTGAGACTCCAGGTACTTCTACCGA | |
| | ESGPGTSTEPSEGSA | | ACCGTCCGAAGGTAGCGCACCAGGTTCTACCAGCGAATCCCCT | |
| | PGSPAGSPTSTEEGT | | TCTGGTACTGCTCCAGGTTCTACCAGCGAATCCCCTTCTGGCAC | |
| | SESATPESGPGSEPA | | CGCACCAGGTACTTCTACCCCTGAAAGCGGCTCCGCTTCTCCAG | |
| | TSGSETPGSSTPSGA | | GTAGCCCGGCAGGCTCTCCGACCTCTACTGAGGAAGGTACTTCT | |
| | TGSPGASPGTSSTGS | | GAAAGCGCAACCCCGGAGTCCGGCCCAGGTACCTCTACCGAAC | |
| | PGSSTPSGATGSPGS | | CGTCTGAGGGCAGCGCACCAGGTAGCCCTGCTGGCTCTCCAAC | |
| | TSESPSGTAPGTSPSG | | CTCCACCGAAGAAGGTACCTCTGAAAGCGCAACCCCTGAATCC | |
| | ESSTAPGSTSSTAESP | | GGCCCAGGTAGCGAACCGGCAACCTCCGGTTCTGAAACCCAG | |
| | GPGSSTPSGATGSPG | | GTAGCTCTACCCCGTCTGGTACCGGTTCCCCAGGTGCTTCT | |
| | ASPGTSSTGSPGTPG | | CCTGGTACTAGCTCTACCGGTTCTCCAGGTAGCTCTACCCCGTC | |
| | SGTASSSPGSPAGSP | | TGGTGCTACTGGCTCTCCAGGTTCTACTAGCGAATCCCCGTCTG | |
| | TSTEEGSPAGSPTSTE | | GTACTGCTCCAGGTACTTCCCCTAGCGGTGAATCTTCTACTGCT | |
| | EGTSTEPSEGSAP | | CCAGGTTCTACCAGCTCTACCGCAGAATCTCCGGGTCCAGGTAG | |
| | | | CTCTACCCCTTCTGGTGCAACGGCTCTCCAGGTGCATCCCCGG | |
| | | | GTACCAGCTCTACCGGTTCTCCAGGTACTCCGGGTAGCGGTACC | |
| | | | GCTTCTTCCTCTCCAGGTAGCCCTGCTGGCTCTCCGACTTCTACT | |
| | | | GAGGAAGGTAGCCCGGCTGGTTCTCCGACTTCTACTGAGGAAG | |
| | | | GTACTTCTACCGAACCTTCCGAAGGTAGCGCTCCA | |

*Sequence name reflects N- to C-terminus configuration of the growth factor and XTEN components

TABLE 36

Exemplary GHXTEN comprising growth hormones and two XTEN sequences

| GHXTEN Name* | Amino Acid Sequence | SEQ ID NO: | DNA Nucleotide Sequence | SEQ ID NO: |
|---|---|---|---|---|
| AE48-hGH-AE144 | MAEPAGSPTSTEEGT PGSGTASSSPGSSTPS GATGSPGASPGTSST GSPGFPTIPLSRLFDN AMLRAHRLHQLAFD TYQEFEEAYIPKEQK YSFLQNPQTSLCFSE SIPTPSNREETQQKS NLELLRISLLLIQSWL EPVQFLRSVFANSLV YGASDSNVYDLLKD LEEGIQTLMGRLEDG SPRTGQIFKQTYSKF DTNSHNDDALLKNY GLLYCFRKDMDKVE TFLRIVQCRSVEGSC GFGGSEPATSGSETP GTSESATPESGPGSE PATSGSETPGSPAGS PTSTEEGTSTEPSEGS APGSEPATSGSETPG SEPATSGSETPGSEP ATSGSETPGTSTEPSE GSAPGTSESATPESG PGSEPATSGSETPGT STEPSEGSAP | 729 | ATGGCTGAACCTGCTGGCTCTCCAACCTCCACTGAGGAAGGTA CCCCGGGTAGCGGTACTGCTTCTTCCTCTCCAGGTAGCTCTACC CCTTCTGGTGCAACCGGCTCTCCAGGTGCTTCTCCGGGCACCAG CTCTACCGGTTCTCCAGGTTTTCCGACTATTCCGCTGTCTCGTCT GTTTGATAATGCTATGCTGCGTGCGCACCGTCTGCACCAGCTGG CCTTTGATACTTACCAGGAATTTGAAGAAGCcTACATTCCTAAA GAGCAGAAGTACTCTTTCCTGCAAAACCCACAGACTTCTCTCTG CTTCAGCGAATCTATTCCGACGCCTTCCAATCGCGAGGAAACTC AGCAAAAGTCCAATCTGGAACTACTCCGCATTTCTCTGCTTCTG ATTCAGAGCTGGCTAGAACCAGTGCAATTTCTGCGTTCCGTCTT CGCCAATAGCCTAGTTTATGGCGCATCCGACAGCAACGTATAC GATCTCCTGAAAGATCTCGAGGAAGGCATTCAGACCCTGATGG GTCGTCTCGAGGATGGCTCTCCGCGTACTGGTCAGATCTTCAAG CAGACTTACTCTAAATTTGATACTAACAGCCACAATGACGATGC GCTTCTAAAAAACTATGGTCTGCTGTATTGTTTTCGTAAAGATA TGGACAAAGTTGAAACCTTCCTGCGTATTGTTCAGTGTCGTTCC GTTGAGGGCAGCTGTGGTTTCTAAGGTGGTAGCGAACCGGCAA CTTCCGGCTCTGAAACCCAGGTACTTCTGAAAGCGCTACTCCT GAGTCTGGCCCAGGTAGCGAACCTGCTACCTCTGGCTCTGAAA CCCCAGGTAGCCGGCAGGCTCTCCGACTTCCACCGAGGAAGG TACCTCTACTGAACCTTCTGAGGGTAGCGCTCCAGGTAGCGAAC CGGCAACCTCTGGCTCTGAAACCCCAGGTAGCGAACCTGCTAC CTCCGGCTCTGAAACTCCAGGTAGCGAACCGGCTACTTCCGGTT CTGAAACTCCAGGTACCTCTACCGAACCTTCCGAAGGCAGCGC ACCAGGTACTTCTGAAAGCGCAACCCCTGAATCCGGTCCAGGT AGCGAACCGGCTACTTCTGGCTCTGAGACTCCAGGTACTTCTAC CGAACCGTCCGAAGGTAGCGCACCA | 730 |
| AM48-hGH-AE144 | MAEPAGSPTSTEEGA SPGTSSTGSPGSSTPS GATGSPGSSTPSGAT GSPGFPTIPLSRLFDN AMLRAHRLHQLAFD TYQEFEEAYIPKEQK YSFLQNPQTSLCFSE SIPTPSNREETQQKS NLELLRISLLLIQSWL EPVQFLRSVFANSLV YGASDSNVYDLLKD LEEGIQTLMGRLEDG SPRTGQIFKQTYSKF DTNSHNDDALLKNY GLLYCFRKDMDKVE TFLRIVQCRSVEGSC GFGGSEPATSGSETP GTSESATPESGPGSE PATSGSETPGSPAGS PTSTEEGTSTEPSEGS APGSEPATSGSETPG SEPATSGSETPGSEP ATSGSETPGTSTEPSE GSAPGTSESATPESG PGSEPATSGSETPGT STEPSEGSAP | 731 | ATGGCTGAACCTGCTGGCTCTCCAACCTCCACTGAGGAAGGTG CATCCCCGGGCACCAGCTCTACCGGTTCTCCAGGTAGCTCTACC CCGTCTGGTGCTACCGGCTCTCCAGGTAGCTCTACCCCGTCTGG TGCTACTGGCTCTCCAGGTTTTCCGACTATTCCGCTGTCTCGTCT GTTTGATAATGCTATGCTGCGTGCGCACCGTCTGCACCAGCTGG CCTTTGATACTTACCAGGAATTTGAAGAAGCcTACATTCCTAAA GAGCAGAAGTACTCTTTCCTGCAAAACCCACAGACTTCTCTCTG CTTCAGCGAATCTATTCCGACGCCTTCCAATCGCGAGGAAACTC AGCAAAAGTCCAATCTGGAACTACTCCGCATTTCTCTGCTTCTG ATTCAGAGCTGGCTAGAACCAGTGCAATTTCTGCGTTCCGTCTT CGCCAATAGCCTAGTTTATGGCGCATCCGACAGCAACGTATAC GATCTCCTGAAAGATCTCGAGGAAGGCATTCAGACCCTGATGG GTCGTCTCGAGGATGGCTCTCCGCGTACTGGTCAGATCTTCAAG CAGACTTACTCTAAATTTGATACTAACAGCCACAATGACGATGC GCTTCTAAAAAACTATGGTCTGCTGTATTGTTTTCGTAAAGATA TGGACAAAGTTGAAACCTTCCTGCGTATTGTTCAGTGTCGTTCC GTTGAGGGCAGCTGTGGTTTCTAAGGTGGTAGCGAACCGGCAA CTTCCGGCTCTGAAACCCAGGTACTTCTGAAAGCGCTACTCCT GAGTCTGGCCCAGGTAGCGAACCTGCTACCTCTGGCTCTGAAA CCCCAGGTAGCCGGCAGGCTCTCCGACTTCCACCGAGGAAGG TACCTCTACTGAACCTTCTGAGGGTAGCGCTCCAGGTAGCGAAC CGGCAACCTCTGGCTCTGAAACCCAGGTAGCGAACCTGCTAC CTCCGGCTCTGAAACTCCAGGTAGCGAACCGGCTACTTCCGGTT CTGAAACTCCAGGTACCTCTACCGAACCTTCCGAAGGCAGCGC ACCAGGTACTTCTGAAAGCGCAACCCCTGAATCCGGTCCAGGT AGCGAACCGGCTACTTCTGGCTCTGAGACTCCAGGTACTTCTAC CGAACCGTCCGAAGGTAGCGCACCA | 732 |
| AE144-hGH-AE144 | GSEPATSGSETPGTS ESATPESGPGSEPAT SGSETPGSPAGSPTST EEGTSTEPSEGSAPG SEPATSGSETPGSEP ATSGSETPGSEPATS GSETPGTSTEPSEGS APGTSESATPESGPG SEPATSGSETPGTSTE PSEGSAPGFPTIPLSR LFDNAMLRAHRLHQ LAFDTYQEFLEAYIP KEQKYSFLQNPQTSL CFSESIPTPSNREETQ QKSNLELLRISLLLIQ SWLEPVQFLRSVFA NSLVYGASDSNVYD LLKDLEEGIQTLMGR | 733 | GGTAGCGAACCGGCAACTTCCGGCTCTGAAACCCCAGGTACTT CTGAAAGCGCTACTCCTGAGTCTGGCCCAGGTAGCGAACCTGC TACCTCTGGCTCTGAAACCCCAGGTAGCCCGGCAGGCTCTCCGA CTTCCACCGAGGAAGGTACCTCTACTGAACCTTCTGAGGGTAGC GCTCCAGGTAGCGAACCGGCAACCTCTGGCTCTGAAACCCCAG GTAGCGAACCTGCTACCTCCGGCTCTGAAACTCCAGGTAGCGA ACCGGCTACTTCCGGTTCTGAAACTCCAGGTACCTCTACCGAAC CTTCCGAAGGCAGCGCACCAGGTACTTCTGAAAGCGCAACCCC TGAATCCGGTCCAGGTAGCGAACCGGCTACTTCTGGCTCTGAA ACTCCAGGTACTTCTACCGAACCGTCCGAAGGTAGCGCACCAG GTTTTCCGACTATTCCGCTGTCTCGTCTGTTTGATAATGCTATGC TGCGTGCGCACCGTCTGCACCAGCTGGCCTTTGATACTTACCAG GAATTTGAAGAAGCcTACATTCCTAAAGAGCAGAAGTACTCTTT CCTGCAAAACCCACAGACTTCTCTCTGCTTCAGCGAATCTATTC CGACGCCTTCCAATCGCGAGGAAACTCAGCAAAAGTCCAATCT GGAACTACTCCGCATTTCTCTGCTTCTGATTCAGAGCTGGCTAG AACCAGTGCAATTTCTGCGTTCCGTCTTCGCCAATAGCCTAGTT TATGGCGCATCCGACAGCAACGTATACGATCTCCTGAAAGATC | 734 |

TABLE 36-continued

Exemplary GHXTEN comprising growth hormones and two XTEN sequences

| GHXTEN Name* | Amino Acid Sequence | SEQ ID NO: | DNA Nucleotide Sequence | SEQ ID NO: |
|---|---|---|---|---|
| | LEDGSPRTGQIFKQT YSKFDTNSHNDDAL LKNYGLLYCFRKDM DKVETFLRIVQCRSV EGSCGFGGSEPATSG SETPGTSESATPESGP GSEPATSGSETPGSP AGSPTSTEEGTSTEPS EGSAPGSEPATSGSE TPGSEPATSGSETPG SEPATSGSETPGTSTE PSEGSAPGTSESATP ESGPGSEPATSGSET PGTSTEPSEGSAP | | TCGAGGAAGGCATTCAGACCCTGATGGGTCGTCTCGAGGATGG CTCTCCGCGTACTGGTCAGATCTTCAAGCAGACTTACTCTAAAT TTGATACTAACAGCCACAATGACGATGCGCTTCTAAAAAACTA TGGTCTGCTGTATTGTTTTCGTAAAGATATGGACAAAGTTGAAA CCTTCCTGCGTATTGTTCAGTGTCGTTCCGTTGAGGGCAGCTGT GGTTTCTAAGGTGGTAGCGAACCGGCAACTTCCGGCTCTGAAA CCCCAGGTACTTCTGAAAGCGCTACTCCTGAGTCTGGCCCAGGT AGCGAACCTGCTACCTCTGGCTCTGAAACCCCAGGTAGCCCGG CAGGCTCTCCGACTTCCACCGAGGAAGGTACCTCTACTGAACCT TCTGAGGGTAGCGCTCCAGGTAGCGAACCGGCAACCTCTGGCT CTGAAACCCCAGGTAGCGAACCGGCTACCTCCGGCTCTGAAAC TCCAGGTAGCGAACCGGCTACTTCCGGTTCTGAAACTCCAGGTA CCTCTACCGAACCTTCCGAAGGCAGCGCACCAGGTACTTCTGA AAGCGCAACCCCTGAATCCGGTCCAGGTAGCGAACCGGCTACT TCTGGCTCTGAGACTCCAGGTACTTCTACCGAACCGTCCGAAGG TAGCGCACCA | |
| AE288-hGH-AE144 | GTSESATPESGPGSE PATSGSETPGTSESA TPESGPGSEPATSGS ETPGTSESATPESGP GTSTEPSEGSAPGSP AGSPTSTEEGTSESA TPESGPGSEPATSGS ETPGTSESATPESGP GSPAGSPTSTEEGSP AGSPTSTEEGTSTEPS EGSAPGTSESATPES GPGTSESATPESGPG TSESATPESGPGSEP ATSGSETPGSEPATS GSETPGSPAGSPTST EEGTSTEPSEGSAPG TSTEPSEGSAPGSEP ATSGSETPGTSESAT PESGPGTSTEPSEGS APGFPTIPLSRLFDNA MLRAHRLHQLAFDT YQEFEEAYIPKEQKY SFLQNPQTSLCFSESI PTPSNREETQQKSNL ELLRISLLLIQSWLEP VQFLRSVFANSLVY GASDSNVYDLLKDL EEGIQTLMGRLEDGS PRTGQIFKQTYSKFD TNSHNDDALLKNYG LLYCFRKDMDKVET FLRIVQCRSVEGSCG FGGSEPATSGSETPG TSESATPESGPGSEP ATSGSETPGSPAGSP TSTEEGTSTEPSEGS APGSEPATSGSETPG SEPATSGSETPGSEP ATSGSETPGTSTEPSE GSAPGTSESATPESG PGSEPATSGSETPGT STEPSEGSAP | 735 | GGTACCTCTGAAAGCGCAACTCCTGAGTCTGGCCCAGGTAGCG AACCTGCTACCTCCGGCTCTGAGACTCCAGGTACCTCTGAAAGC GCAACCCCGGAATCTGGTCCAGGTAGCGAACCTGCAACCTCTG GCTCTGAAACCCCAGGTACCTCTGAAAGCGCTACTCCTGAATCT GGCCCAGGTACTTCTACTGAACCGTCCGAGGGCAGCGCACCAG GTAGCCCTGCTGGCTCTCCAACCTCCACCGAAGAAGGTACCTCT GAAAGCGCAACCCCTGAATCCGGCCCAGGTAGCGAACCGGCAA CCTCCGGTTCTGAAACCCCAGGTACTTCTGAAAGCGCTACTCCT GAGTCCGGCCCAGGTAGCCCGGCTGGCTCTCCGACTTCCACCG AGGAAGGTAGCCCGGCTGGCTCCAACTTCTACTGAAGAAGG TACTTCTACCGAACCTTCCGAGGGCAGCGCACCAGGTACTTCTG AAAGCGCTACCCCTGAGTCCGGCCCAGGTACTTCTGAAAGCGC TACTCCTGAATCCGGTCCAGGTACTTCTGAAAGCGCTACCCCGG AATCTGGCCCAGGTAGCGAACCGGCTACTTCTGGTTCTGAAACC CCAGGTAGCGAACCGGCTACCTCCGGTTCTGAAACTCCAGGTA GCCCAGCAGGCTCTCCGACTTCCACTGAGGAAGGTACTTCTACT GAACCTTCCGAAGGCAGCGCACCAGGTACTTCTACTGAACCTT CTGAGGGCAGCGCTCCAGGTAGCGAACCTGCAACCTCTGGCTC TGAAACCCCAGGTACCTCTGAAAGCGCTACTCCTGAATCTGGCC CAGGTACTTCTACTGAACCGTCCGAGGGCAGCGCACCAGGTTTT CCGACTATTCCGCTGTCTCGTCTGTTTGATAATGCTATGCTGCGT GCGCACCGTCTGCACCAGCTGGCCTTTGATACTTACCAGGAATT TGAAGAAGCcTACATTCCTAAAGAGCAGAAGTACTCTTTCCTGC AAAACCCACAGACTTCTCTCTGCTTCAGCGAATCTATTCCGACG CCTTCCAATCGCGAGGAAACTCAGCAAAAGTCCAATCTGGAAC TACTCCGCATTTCTCTGCTTCTGATTCAGAGCTGGCTAGAACCA GTGCAATTTCTGCGTTCCGTCTTCGCCAATAGCCTAGTTTATGG CGCATCCGACAGCAACGTATACGATCTCCTGAAAGATCTCGAG GAAGGCATTCAGACCCTGATGGGTCGTCTCGAGGATGGCTCTC CGCGTACTGGTCAGATCTTCAAGCAGACTTACTCTAAATTTGAT ACTAACAGCCACAATGACGATGCGCTTCTAAAAAACTATGGCT TGCTGTATTGTTTTCGTAAAGATATGGACAAAGTTGAAACCTTC CTGCGTATTGTTCAGTGTCGTTCCGTTGAGGGCAGCTGTGGTTT CTAAGGTGGTAGCGAACCGGCAACTTCCGGCTCTGAAACCCCA GGTACTTCTGAAAGCCCAGGTAGCCCTGAGTCTGGCCCAGGTAGCG AACCTGCTACCTCTGGCTCTGAAACCCCAGGTAGCCCGGCAGG CTCTCCGACTTCCACCGAGGAAGGTACCTCTACTGAACCTTCTG AGGGTAGCGCTCCAGGTAGCGAACCGGCAACCTCTGGCTCTGA AACCCCAGGTAGCGAACCTGCTACCTCCGGCTCTGAAACTCCA GGTAGCGAACCGGCTACTTCCGGTTCTGAAACTCCAGGTACCTC TACCGAACCTTCCGAAGGCAGCGCACCAGGTACTTCTGAAAGC GCAACCCCTGAATCCGGTCCAGGTAGCGAACCGGCTACTTCTG GCTCTGAGACTCCAGGTACTTCTACCGAACCGTCCGAAGGTAG CGCACCA | 736 |
| AF144-hGH-AE144 | GTSTPESGSASPGTSP SGESSTAPGTSPSGES STAPGSTSSTAESPGP GSTSESPSGTAPGSTS STAESPGPGTSPSGES STAPGTSTPESGSASP GSTSSTAESPGPGTSP SGESSTAPGTSPSGES STAPGTSPSGESSTAP GFPTIPLSRLFDNAM LRAHRLHQLAFDTY QEFEEAYIPKEQKYS | 737 | GGTACTTCTACTCCGGAAAGCGGTTCCGCATCTCCAGGTACTTC TCCTAGCGGTGAATCTTCTACTGCTCCAGGTACCTCTCCTAGCG GCGAATCTTCTACTGCTCCAGGCTCCACCAGCTCTACCGCTGAA TCTCCTGGCCCAGGTTCTACCAGCGAATCCCCGTCTGGCACCGC ACCAGGTTCTACTAGCTCTACCGCAGAATCTCCGGGTCCAGGTA CTTCCCCTAGCGGTGAATCTTCTACTGCTCCAGGTACCTCTACT CCCGGAAAGCGGCTCCGCATCTCCAGGTTCTACCTCTAGCTACTG A AATCTCCTGGTCCAGGTACCTCCCCTAGCGGCGAATCTTCTA CTGCTCCAGGTACCTCTCCTAGCGGCGAATCTTCTACCGCTCCA GGTACCTCCCCTAGCGGTGAATCTTCTACCGCACCAGGTTTTCC GACTATTCCGCTGTCTCGTCTGTTTGATAATGCTATGCTGCGTG CGCACCGTCTGCACCAGCTGGCCTTTGATACTTACCAGGAATTT | 738 |

TABLE 36-continued

Exemplary GHXTEN comprising growth hormones and two XTEN sequences

| GHXTEN Name* | Amino Acid Sequence | SEQ ID NO: | DNA Nucleotide Sequence | SEQ ID NO: |
|---|---|---|---|---|
| | FLQNPQTSLCFSESIP TPSNREETQQKSNLE LLRISLLLIQSWLEPV QFLRSVFANSLVYG ASDSNVYDLLKDLE EGIQTLMGRLEDGSP RTGQIFKQTYSKFDT NSHNDDALLKNYGL LYCFRKDMDKVETF LRIVQCRSVEGSCGF GGSEPATSGSETPGT SESATPESGPGSEPA TSGSETPGSPAGSPTS TEEGTSTEPSEGSAP GSEPATSGSETPGSE PATSGSETPGSEPAT SGSETPGTSTEPSEGS APGTSESATPESGPG SEPATSGSETPGTSTE PSEGSAP | | GAAGAAGCcTACATTCCTAAAGAGCAGAAGTACTCTTTCCTGCA AAACCCACAGACTTCTCTCTGCTTCAGCGAATCTATTCCGACGC CTTCCAATCGCGAGGAAACTCAGCAAAAGTCCAATCTGGAACT ACTCCGCATTTCTCTGCTTCTGATTCAGAGCTGGCTAGAACCAG TGCAATTTCTGCGTTCCGTCTTCGCCAATAGCCTAGTTTATGGC GCATCCGACAGCAACGTATACGATCTCCTGAAAGATCTCGAGG AAGGCATTCAGACCCTGATGGGTCGTCTCGAGGATGGCTCTCC GCGTACTGGTCAGATCTTCAAGCAGACTTACTCTAAATTTGATA CTAACAGCCACAATGACGATGCGCTTCTAAAAAACTATGGTCT GCTGTATTGTTTTCGTAAAGATATGGACAAAGTTGAAACCTTCC TGCGTATTGTTCAGTGTCGTTCCGTTGAGGGCAGCTGTGGTTTC TAAGGTGGTAGCGAACCGGCAACTTCCGGCTCTGAAACCCCAG GTACTTCTGAAAGCGCTACTCCTGAGTCTGGCCCAGGTAGCGA ACCTGCTACCTCTGGCTCTGAAACCCCAGGTAGCCCGGCAGGCT CTCCGACTTCCACCGAGGAAGGTACCTCTACTGAACCTTCTGAG GGTAGCGCTCCAGGTAGCGAACCGGCAACCTCTGGCTCTGAAA CCCCAGGTAGCGAACCTGCTACCTCCGGCTCTGAAACTCCAGGT AGCGAACCGGCTACTTCCGGTTCTGAAACTCCAGGTACCTCTAC CGAACCTTCCGAAGGCAGCGCACCAGGTACTTCTGAAAAGCGCA ACCCCTGAATCCGGTCCAGGTAGCGAACCGGCTACTTCTGGCTC TGAGACTCCAGGTACTTCTACCGAACCGTCCGAAGGTAGCGCA CCA | |
| AD576-hGH-AE144 | GSSESGSSEGGPGSG GEPSESGSSGSSESGS SEGGPGSSESGSSEG GPGSSESGSSEGGPG SSESGSSEGGPGSSES GSSEGGPGESPGGSS GSESGSEGSSGPGES SGSSESGSSEGGPGS SESGSSEGGPGSSES GSSEGGPGSGGEPSE SGSSGESPGGSSGSE SGESPGGSSGSESGS GGEPSESGSSGSSES GSSEGGPGSGGEPSE SGSSGSGGEPSESGS SGSEGSSGPGESSGE SPGGSGSESGSSGGE PSESGSSGSGGEPSES GSSGSGGEPSESGSS GSSESGSSEGGPGES PGSSGSESGESPGG SSGSESGESPGGSSG SESGESPGGSSGSES ESGSSGSGGEPSESGSS GSSESGSSEGGPGES ESSGSSESGSSEGGP GSGGEPSESGSSGSS ESGSSEGGPGSSGGEP SESGSSGESPGGSSG SESGESPGGSSGSES GSSESGSSEGGPGSG GEPSESGSSGSSESGS SEGGPGSGGEPSESG SSGSGGGEPSESGSSG ESPGGSSGSESGSEG EGGPGSEGSSGPGES SGFPTIPLSRLFDNA MLRAHRLHQLAFDT YQEFEEAYIPKEQKY SFLQNPQTSLCFSESI PTPSNREETQQKSNL ELLRISLLLIQSWLEP VQFLRSVFANSLVY GASDSNVYDLLKDL EEGIQTLMGRLEDGS PRTGQIFKQTYSKFD TNSHNDDALLKNYG LLYCFRKDMDKVET FLRIVQCRSVEGSCG | 739 | GGTTCCTCTGAAAGCGGTTCTTCCGAAGGTGGTCCAGGTTCCTC TGAAAGCGGTTCTTCTGAGGGTGGTCCAGGTGAATCTCCGGGT GGCTCCAGCGGTTCCGAGTCAGGTTCTGGTGGCGAACCTTCCGA GTCTGGTAGCTCAGGTGAATCTCCGGGTGGTTCTAGCGGTTCCG AGTCAGGTGAATCTCCGGGTGGTTCCAGCGGTTCTGAGTCAGGT TCCTCCGAAAGCGGTTCTTCTGAGGGCGGTCCAGGTTCCTCCGA AAGCGGTTCTTCCGAGGGCGGTCCAGGTTCTTCTGAAAGCGGTT CTTCCGAGGGCGGTCCAGGTGAATCTCCGGTGGTTCCAGCGGT TCCGAGTCAGGTGAATCTCCAGGTGCTCTAGCGGTTCCGAGTC AGGTGAATCTCCTGGTGGTTCTAGCGGTTCTGAATCAGGTTCCT CCGAAAGCGGTTCTTCTGAGGGCGGTCCAGGTTCCTCCGAAAG CGGTTCTTCCGAGGGCGGTCCAGGTTCTTCTGAAAGCGGTTCTT CCGAGGGCGGTCCAGGTTCCTCTGAAAGCGGTTCTTCTGAGGG CGGTCCAGGTTCTTCCGAAAGCGGTTCTTCCGAGGGCGGTCCAG GTTCTTCCGAAAGCGGTTCTTCTGAAGGCGGTCCAGGTTCTGGT GGCGAACCGTCCGAGTCTGGTAGCTCAGGTGAATCTCCGGGTG GCTCTAGCGGTTCCGAGTCAGGTGAATCTCCTGGTGGTTCCAGC GGTTCCGAGTCAGGTTCCGGTGGCGAACCGTCCGAATCTGGTA GCTCAGGTAGCGAAGGTTCTTCTGGTCCAGGCGAATCTTCAGGT TCCTCTGAAAGCGGTTCTTCTGAGGGCGGTCCAGGTTCCGGTGG CGAACCGTCCGAATCTGGTAGCTCAGGTAGCGAAGGTTCTTCTG GTCCAGGCGAATCTTCAGGTTCCTCTGAAAGCGGTTCTTCTGAG GGCGGTCCAGGTTCCGGTGGCGAACCTTCCGAATCTGGTAGCTC AGGTGAATCTCCGGGTGGTTCTAGCGGTTCTGAGTCAGGTTCTG GTGGTGAACCTTCCGAGTCTGGTAGCTCAGGTTCTTGGTGGCGAA CCATCCGAGTCTGGTAGCTCAGGTTCTTCCGAAAGCGGTTCTTC CGAAGGCGGTCCAGGTTCTGGTGGTGAACCGTCCGAATCTGGT AGCTCAGGTTCTGGTGGCGAACCATCCGAATCTGGTAGCTCAG GTAGCGAAGGTTCTTCTGGTCCTGGCGAATCTTCAGGTGAATCT CCAGGTGGCTCTAGCGGTTCCGAATCAGGTAGCGAAGGTTCTTC CGGTCCAGGTGAATCTTCAGGTAGCGAAGGTTCTTCTGGTCCTG GTGAATCCTCAGGTTCCGGTGGCGAACCATCTGAATCTGGTAGC TCAGGTTCCTCTGAAAGCGGTTCTTCCGAAGGTGGTCCAGGTTC CTCTGAAAGCGGTTCTTCTGAGGGTGGTCCAGGTGAATCTCCGG GTGGCTCCAGCGGTTCCGAGTCAGGTTCTGGTGGCGAACCATCC GAATCTGGTAGCTCAGGTAGCGAAGGTTCTTCTGGTCCTGGCGA ATCTTCAGGTGAATCTCCAGGTGGCTCTAGCGGTTCCGAATCAG GTAGCGAAGGTTCTTCCGGTCCTGGTGAGTCTTCAGGTGAATCT CCAGGTGGCTCTAGCGGTTCCGAGTCAGGTAGCGAAGGTTCTTC TGGTCCTGGCGAGTCCTCAGGTTTTCCGACTATTCCGCTGTCTC GTCTGTTTGATAATGCTATGCTGCGTGCGCACCGTCTGCACCAG CTGGCCTTTGATACTTACCAGGAGTTTGAAGAAGCcTACATTCC TAAAGAGCAGAAGTACTCTTTCCTGCAAAACCCACAGACTTCTC TCTGCTTCAGCGAATCTATTCCGACGCCTTCCAATCGCGAGGAA ACTCAGCAAAAGTCCAATCTGGAACTACTCCGCATTTCTCTGCT TCTGATTCAGAGCTGGCTAGAACCAGTGCAATTTCTGCGTTCCG TCTTCGCCAATAGCCTAGTTTATGGCGCATCCGACAGCAACGTA TACGATCTCCTGAAAGATCTCGAGGAAGGCATTCAGACCCTGA TGGGTCGTCTCGAGGATGGCTCTCCGCGTACTGGTCAGATCTTC AAGCAGACTTACTCTAAATTTGATACTAACAGCCACAATGACG ATGCGCTTCTAAAAAACTATGGTCTGCTGTATTGTTTTCGTAAA | 740 |

TABLE 36-continued

Exemplary GHXTEN comprising growth hormones and two XTEN sequences

| GHXTEN Name* | Amino Acid Sequence | SEQ ID NO: | DNA Nucleotide Sequence | SEQ ID NO: |
|---|---|---|---|---|
| | FGGSEPATSGSETPG TSESATPESGPGSEP ATSGSETPGSPAGSP TSTEEGTSTEPSEGS APGSEPATSGSETPG SEPATSGSETPGSEP ATSGSETPGTSTEPSE GSAPGTSESATPESG PGSEPATSGSETPGT STEPSEGSAP | | GATATGGACAAAGTTGAAACCTTCCTGCGTATTGTTCAGTGTCG TTCCGTTGAGGGCAGCTGTGGTTTCTAAGGTGGTAGCGAACCG GCAACTTCCGGCTCTGAAACCCAGGTACTTCTGAAAGCGCTAC TCCTGAGTCTGGCCCAGGTAGCGAACCTGCTACCTCTGGCTCTG AAACCCCAGGTAGCCCGGCAGGCTCTCCGACTTCCACCGAGGA AGGTACCTCTACTGAACCTTCTGAGGGTAGCGCTCCAGGTAGC GAACCGGCAACCTCTGGCTCTGAAACCCAGGTAGCGAACCTG CTACCTCCGGCTCTGAAACTCCAGGTAGCGAACCGGCTACTTCC GGTTCTGAAACTCCAGGTACCTCTACCGAACCTTCCGAAGGCA GCGCACCAGGTACTTCTGAAAGCGCAACCCCTGAATCCGGTCC AGGTAGCGAACCGGCTACTTCTGGCTCTGAGACTCCAGGTACTT CTACCGAACCGTCCGAAGGTAGCGCACCA | |
| AE576-hGH-AE144 | GSPAGSPTSTEEGTS ESATPESGPGTSTEPS EGSAPGSPAGSPTST EEGTSTEPSEGSAPG TSTEPSEGSAPGTSES ATPESGPGSEPATSG SETPGSEPATSGSETP GSPAGSPTSTEEGTS ESATPESGPGTSTEPS EGSAPGTSTEPSEGS APGSPAGSPTSTEEG TSTEPSEGSAPGTSTE PSEGSAPGTSESATP ESGPGTSTEPSEGSA PGTSESATPESGPGS EPATSGSETPGTSTEP SEGSAPGTSTEPSEG SAPGTSESATPESGP GTSESATPESGPGSP AGSPTSTEEGTSESA TPESGPGSEPATSGS ETPGTSESATPESGP GTSTEPSEGSAPGTS TEPSEGSAPGTSTEPS EGSAPGTSTEPSEGS APGTSTEPSEGSAPG TSTEPSEGSAPGSPA GSPTSTEEGTSTEPSE GSAPGTSESATPESG PGSEPATSGSETPGT SESATPESGPGSEPA TSGSETPGTSESATPE SGPGTSTEPSEGSAP GTSESATPESGPGSP AGSPTSTEEGSPAGS PTSTEEGSPAGSPTST EEGTSESATPESGPG TSTEPSEGSAPGFPTI PLSRLFDNAMLRAH RLHQLAFDTYQEFEE AYIPKEQKYSFLQNP QTSLCFSESIPTPSNR EETQQKSNLELLRIS LLLIQSWLEPVQFLR SVFANSLVYGASDS NVYDLLKDLEEGIQT LMGRLEDGSPRTGQI FKQTYSKFDTNSHN DDALLKNYGLLYCF RKDMDKVETFLRIV QCRSVEGSCGFGSE PATSGSETPGTSESA TPESGPGSEPATSGS ETPGSPAGSPTSTEE GTSTEPSEGSAPGSE PATSGSETPGSEPAT SGSETPGSEPATSGS ETPGTSTEPSEGSAP GTSESATPESGPGSE | 741 | GGTAGCCCGGCTGGCTCTCCTACCTCTACTGAGGAAGGTACTTC TGAAAGCGCTACTCCTGAGTCTGGTCCAGGTACCTCTACTGAAC CGTCCGAAGGTAGCGCTCCAGGTAGCCCAGCAGGCTCTCCGAC TTCCACTGAGGAAGGTACTTCTACTGAACCTTCCGAAGGCAGC GCACCAGGTACCTCTACTGAACCTTCTGAGGGCAGCGCTCCAG GTACTTCTGAAAGCGCTACCCCGGAATCTGGCCCAGGTAGCGA ACCGGCTACTTCTGGTTCTGAAACCCCAGGTAGCGAACCGGCT ACCTCCGGTTCTGAAACTCCAGGTAGCCCGGCAGGCTCTCCGAC CTCTACTGAGGAAGGTACTTCTGAAAGCGCAACCCCGGAGTCC GGCCCAGGTACCTCTACCGAACCGTCTGAGGGCAGCGCACCAG GTACTTCTACCGAACCGTCCGAGGGTAGCGCACCAGGTAGCCC AGCAGGTTCTCCTACCTCCACCGAGGAAGGTACTTCTACCGAAC CGTCCGAGGGTAGCGCACCAGGTACCTCTACTGAACCTTCTGA GGGCAGCGCTCCAGGTACTTCTGAAAGCGCTACCCCGGAGTCC GGTCCAGGTACTTCTGAAAGCGCTACCCCGGAATCCGGTCCAG GTACTTCTAAAGCGCAACCCCTGAATCCGGTCCAGGTAGCGA ACCGGCTACTTCTGGCTCTGAGACTCCAGGTACTTCTACCGAAC CGTCCGAAGGTAGCGCACCAGGTACTTCTACTGAACCGTCTGA AGGTAGCGAACCGGCTACTTCTGAAAGCGCAACCCCGGAATCC GGCCCAGGTACCTCTGAAAGCGCAACCCCGGAGTCCGGCCCAG GTAGCCCTGCTGGCTCTCCAACCTCCACCGAAGAAGGTACCTCT GAAAGCGCAACCCCTGAATCCGGCCCAGGTAGCGAACCGGCAA CCTCCGGTTCTGAAACCCCAGGTACTTCTGAAAGCGCTACTCCG GAGTCTGGCCCAGGTACCTCTACTGAACCGTCTGAGGGTAGCG CTCCAGGTACTTCTACTGAACCGTCCGAAGGTAGCGCACCAGG TACTTCTACCGAACCGTCCGAAGGCAGCGCTCCAGGTACCTCTA CTGAACCTTCCGAGGGCAGCGCTCCAGGTACCTCTACCGAACCT TCTGAAGGTAGCGCACCAGGTACTTCTACCGAACCGTCCGAGG GTAGCGCACCAGGTAGCCCAGCAGGTTCTCCTACCTCCACCGA GGAAGGTACTTCTACCGAACCGTCCGAGGGTAGCGCACCAGGT ACCTCTGAAAGCGCAACTCCTGAGTCTGGCCCAGGTAGCGAAC CTGCTACCTCCGGCTCTGAGACTCCAGGTACCTCTGAAAGCGCA ACCCCGGAATCTGGTCCAGGTAGCGAACCTGCAACCTCTGGCT CTGAAACCCCAGGTACCTCTGAAAGCGCTACTCCTGAATCTGGC CCAGGTACTTCTACTGAACCGTCCGAGGGCAGCGCACCAGGTA CTTCTGAAAGCGCTACTCCTGAGTCGGCCCAGGTAGCCCGGCT GGCTCTCCGACTTCCACCGAGGAAGGTACCTCTACTGAACCTTCT GAGGGTAGCGCTCCAGGTAGCGAACCGGCAACCTCTGGCTCTG AAACCCCAGGTAGCGAACCTGCTACCTCCGGCTCTGAAACTCC | 742 |

TABLE 36-continued

Exemplary GHXTEN comprising growth hormones and two XTEN sequences

| GHXTEN Name* | Amino Acid Sequence | SEQ ID NO: | DNA Nucleotide Sequence | SEQ ID NO: |
|---|---|---|---|---|
| | PATSGSETPGTSTEPS EGSAP | | AGGTAGCGAACCGGCTACTTCCGGTTCTGAAACTCCAGGTACCT CTACCGAACCTTCCGAAGGCAGCGCACCAGGTACTTCTGAAAG CGCAACCCCTGAATCCGGTCCAGGTAGCGAACCGGCTACTTCT GGCTCTGAGACTCCAGGTACTTCTACCGAACCGTCCGAAGGTA GCGCACCA | |
| AF576- hGH- AE144 | GSTSSTAESPGPGSTS STAESPGPGSTSESPS GTAPGSTSSTAESPG PGSTSSTAESPGPGTS TPESGSASPGSTSESP SGTAPGTSPSGESST APGSTSESPSGTAPG STSESPSGTAPGTSPS GESSTAPGSTSESPSG TAPGSTSESPSGTAP GTSPSGESSTAPGSTS ESPSGTAPGSTSESPS GTAPGSTSESPSGTA PGTSTPESGSASPGST SESPSGTAPGTSTPES GSASPGSTSSTAESP GPGSTSSTAESPGPG TSTPESGSASPGTSTP ESGSASPGSTSESPSG TAPGTSTPESGSASP GTSTPESGSASPGSTS ESPSGTAPGSTSESPS GTAPGSTSESPSGTA PGSTSSTAESPGPGTS TPESGSASPGTSTPES GSASPGSTSESPSGT APGSTSESPSGTAPG TSTPESGSASPGSTSE SPSGTAPGSTSESPSG TAPGTSTPESGSASP GTSPSGESSTAPGSTS STAESPGPGTSPSGES STAPGSTSSTAESPGP GTSTPESGSASPGSTS ESPSGTAPGSTSSTA ESPGPGTSTPESGSAS PGTSTPESGSASPGFP TIPLSRLFDNAMLRA HRLHQLAFDTYQEF EEAYIPKEQKYSFLQ NPQTSLCFSESIPTPS NREETQQKSNLELLR ISLLLIQSWLEPVQFL RSVFANSLVYGASD SNVYDLLKDLEEGIQ TLMGRLEDGSPRTG QIFKQTYSKFDTNSH NDDALLKNYGLLYC FRKDMDKVETFLRI VQCRSVEGSCGFGG SEPATSGSETPGTSES ATPESGPGSEPATSG SETPGSPAGSPTSTEE GTSTEPSEGSAPGSE PATSGSETPGSEPAT SGSETPGSEPATSGS ETPGTSTEPSEGSAP GTSESATPESGPGSE PATSGSETPGTSTEPS EGSAP | 743 | GGTTCTACTAGCTCTACCGCTGAATCTCCTGGCCCAGGTTCCAC TAGCTCTACCGCAGAATCTCCGGGCCCAGGTTCTACTAGCGAAT CCCCTTCTGGTACCGCTCCAGGTTCTACTAGCTCTACCGCTGAA TCTCCGGGTCCAGGTTCTACCAGCTCTACTGCAGAATCTCCTGG CCCAGGTACTTCTACTCCGGAAAGCGGTTCCGCTTCTCCAGGTT CTACCAGCGAATCTCCTTCTGGCACCGCTCCAGGTACCTCTCCT AGCGGCGAATCTTCTACCGCTCCAGGTTCTACTAGCGAATCTCC TTCTGGCACTGCACCAGGTTCTACCAGCGAATCTCCTTCTGGCA CCGCTCCAGGTACCTCTCCTAGCGGCGAATCTTCTACCGCTCCA GGTTCTACTAGCGAATCTCCTTCTGGCACTGCACCAGGTTCTAC CAGCGAATCTCCTTCTGGCACCGCTCCAGGTACCTCTCCTAGCG GCGAATCTTCTACCGCTCCAGGTTCTACTAGCGAATCTCCTTCT GGCACTGCACCAGGTTCTACTAGCGAATCTCCTTCTGGCACTGC ACCAGGTTCTACCAGCGAATCTCCGTCTGGCACTGCACCAGGTA CCTCTACCCCTGAAAGCGGTTCCGCTTCTCCAGGTTCTACTAGC GAATCTCCTTCTGGTACCGCTCCAGGTACTTCTACCCCTGAAAG CGGCTCCGCTTCCACTAGCTCTACCGCTGAATCTC CGGGTCCAGGTTCTACTAGCTCTACTGCAGAATCTCCTGGCCCA GGTACCTCTACTCCGGAAAGCGGCTCTGCATCTCCAGGTACTTC TACCCCTGAAAGCGGTTCTGCATCTCCAGGTTCTACTAGCGAAT CCCCGTCTGGTACCGCACCAGGTACTTCTACCCCGGAAAGCGG CTCTGCTTCTCCAGGTACTTCTACCCCGGAAAGCGGCTCCGCAT CTCCAGGTTCTACTAGCGAATCTCCTTCTGGTACCGCTCCAGGT TCTACCAGCGAATCCCCGTCTGGTACTGCTCCAGGTTCTACCAG CGAATCTCCTTCTGGTACTGCACCAGGTTCTACTAGCTCTACTG CAGAATCTCCTGGCCCAGGTACCTCTACTCCGGAAAGCGGCTCT GCATCTCCAGGTACTTCTACCCCTGAAAGCGGTTCTGCATCTCC AGGTTCTACTAGCGAATCTCCTTCTGGCACTGCACCAGGTTCTA CCAGCGAATCTCCGTCTGGCACTGCACCAGGTACCTCTACCCCT GAAAGCGGTTCCGCTTCTCCAGGTTCTACTAGCGAATCTCCTTC TGGCACTGCACCAGGTTCTACCAGCGAATCTCCGTCTGGCACTG CACCAGGTACCTCTACCCCTGAAAGCGGTTCCGCTTCTCCAGGT ACTTCTCCGAGCGGTGAATCTTCTACCGCACCAGGTTCTACTAG CTCTACCGCTGAATCTCCGGGACCAGGTACTTCTCCGAGCGGTG AATCTTCTACTGCTCCAGGTTCCACTAGCTCTACTGCTGAATCT CCTGGCCCAGGTACTTCTACTCCGGAAAGCGGTTCCGCTTCTCC AGGTTCTACTAGCGAATCTCCGTCTGGCACCGCACCAGGTTCTA CTAGCTCTACTGCAGAATCTCCTGGCCCAGGTACCTCTACTCCG GAAAGCGGCTCTGCATCTCCAGGTACTTCTACCCCTGAAAGCG GTTCTGCATCTCCAGGTTTTCCGACTATTCCGCTGTCTCGTCTGT TTGATAATGCTATGCTGCGTGCGCACCGTCTGCACCAGCTGGCC TTTGATACTTACCAGGAATTTGAAGAAGCcTACATTCCTAAAGA GCAGAAGTACTCTTTCCTGCAAACCCACAGACTTCTCTCTGCT TCAGCGAATCTATTCCGACGCCTTCCAATCGCGAGGAAACTCA GCAAAAGTCCAATCTGGAACTACTCCGCATTTCTCTGCTTCTGA TTCAGAGCTGGCTAGAACCAGTGCAATTTCTGCGTTCCGTCTTC GCCAATAGCCTAGTTTATGGCGCATCCGACAGCAACGTATACG ATCTCCTGAAAGATCTCGAGGAAGGCATTCAGCCCTGATGGG TCGTCTCGAGGATGGCTCTCCGCGTACTGGTCAGATCTTCAAGC AGACTTACTCTAAATTTGATACTAACAGCCACAATGACGATGC GCTTCTAAAAAACTATGGTCTGCTGTATTGTTTTCGTAAAGATA TGGACAAAGTTGAAACCTTCCTGCGTATTGTTCAGTGTCGTTCC GTTGAGGGCAGCTGTGGTTTCGGTGGTAGCGAACCGGCAA CTTCCGGCTCTGAAACCCAGGTACTTCTGAAAGCGCTACTCCT GAGTCTGGCCCAGGTAGCGAACCTGCTACCTCTGGCTCTGAAA CCCCAGGTAGCCCGGCAGGCTCTCCGACTTCCACCGAGGAAGG TACCTCTACTGAACCTTCTGAGGGTAGCGCTCCAGGTAGCGAAC CGGCAACCTCTGGCTCTGAAACCCCAGGTAGCGAACCTGCTAC CTCCGGCTCTGAAACTCCAGGTAGCGAACCGGCTACTTCCGGTT CTGAAACTCCAGGTACCTCTACCGAACCTTCCGAAGGCAGCGC ACCAGGTACTTCTGAAAGCGCAACCCCTGAATCCGGTCCAGGT AGCGAACCGGCTACTTCTGGCTCTGAGACTCCAGGTACTTCTAC CGAACCGTCCGAAGGTAGCGCACCA | 744 |
| AE624- hGH- AE144 | MAEPAGSPTSTEEGT PGSGTASSSPGSSTPS GATGSPGASPGTSST GSPGSPAGSPTSTEE | 745 | ATGGCTGAACCTGCTGGCTCTCCAACCTCCACTGAGGAAGGTA CCCCGGGTAGCGGTACTGCTTCTTCCTCTCCAGGTAGCTCTACC CCTTCTGGTGCAACCGGCTCTCCAGGTGCTTCTCCGGGCACCAG CTCTACCGGTTCTCCAGGTAGCCCGGCTGGCTCTCCACCTCTA | 746 |

TABLE 36-continued

Exemplary GHXTEN comprising growth hormones and two XTEN sequences

| GHXTEN Name* | Amino Acid Sequence | SEQ ID NO: | DNA Nucleotide Sequence | SEQ ID NO: |
|---|---|---|---|---|
| | GTSESATPESGPGTS TEPSEGSAPGSPAGS PTSTEEGTSTEPSEGS APGTSTEPSEGSAPG TSESATPESGPGSEP ATSGSETPGSEPATS GSETPGSPAGSPTST EEGTSESATPESGPG TSTEPSEGSAPGTSTE PSEGSAPGSPAGSPT STEEGTSTEPSEGSAP GTSTEPSEGSAPGTS ESATPESGPGTSTEPS EGSAPGTSESATPES GPGSEPATSGSETPG TSTEPSEGSAPGTSTE PSEGSAPGTSESATP ESGPGTSESATPESG PGSPAGSPTSTEEGT SESATPESGPGSEPA TSGSETPGTSESATPE SGPGTSTEPSEGSAP GTSTEPSEGSAPGTS TEPSEGSAPGTSTEPS EGSAPGTSTEPSEGS APGTSTEPSEGSAPG SPAGSPTSTEEGTSTE PSEGSAPGTSESATP ESGPGSEPATSGSET PGTSESATPESGPGS EPATSGSETPGTSES ATPESGPGTSTEPSE GSAPGTSESATPESG PGSPAGSPTSTEEGSP AGSPTSTEEGSPAGS PTSTEEGTSESATPES GPGTSTEPSEGSAPG FPTIPLSRLFDNAML RAHRLHQLAFDTYQ EFEEAYIPKEQKYSF LQNPQTSLCFSESIPT PSNREETQQKSNLEL LRISLLLIQSWLEPVQ FLRSVFANSLVYGAS DSNVYDLLKDLEEGI QTLMGRLEDGSPRT GQIFKQTYSKFDTNS HNDDALLKNYGLLY CFRKDMDKVETFLRI VQCRSVEGSCGFGG SEPATSGSETPGTSES ATPESGPGSEPATSG SETPGSPAGSPTSTEE GTSTEPSEGSAPGSE PATSGSETPGSEPAT SGSETPGSEPATSGS ETPGTSTEPSEGSAP GTSESATPESGPGSE PATSGSETPGTSTEPS EGSAP | | CTGAGGAAGGTACTTCTGAAAGCGCTACTCCTGAGTCTGGTCCA GGTACCTCTACTGAACCGTCCGAAGGTAGCGCTCCAGGTAGCC CAGCAGGCTCTCCGACTTCCACTGAGGAAGGTACTTCTACTGAA CCTTCCGAAGGCAGCGCACCAGGTACCTCTACTGAACCTTCTGA GGGCAGCGCTCCAGGTACTTCTGAAAGCGCTACCCCGGAATCT GGCCCAGGTAGCGAACCGGCTACTTCTGGTTCTGAAACCCCAG GTAGCGAACCGGCTACCTCCGGTTCTGAAACTCCAGGTAGCCC GGCAGGCTCTCCGACCTCTACTGAGGAAGGTACTTCTGAAAGC GCAACCCCGGAGTCCGGCCCAGGTACCTCTACCGAACCGTCTG AGGGCAGCGCACCAGGTACTTCTACCGAACCGTCCGAGGGTAG CGCACCAGGTAGCCCAGCAGGTTCTCCTACCTCCACCGAGGAA GGTACTTCTACCGAACCGTCCGAGGGTAGCGCACCAGGTACCT CTACTGAACCTTCTGAGGGCAGCGCTCCAGGTACTTCTGAAAGC GCTACCCCGGAGTCCGGTCCAGGTACTTCTACTGAACCGTCCGA AGGTAGCGCACCAGGTACTTCTGAAAGCGCAACCCCTGAATCC GGTCCAGGTAGCGAACCGGCTACTTCTGGCTCTGAGACTCCAG GTACTTCTACCGAACCGTCCGAAGGTAGCGCACCAGGTACTTCT ACTGAACCGTCTGAAGGTAGCGCACCAGGTACTTCTGAAAGCG CAACCCCGGAATCCGGCCCAGGTACTTCTGAAAGCGCAACCCC GGAGTCCGGCCCAGGTAGCCCTGCTGGCTCTCCAACCTCCACCG AAGAAGGTACTTCTGAAAGCGCAACCCCTGAATCCGGCCCAGG TAGCGAACCGGCAACCTCCGGTTCTGAAACCCCAGGTACCTCT GAAAGCGCTACTCCGGAGTCTGGCCCAGGTACCTCTACTGAAC CGTCTGAGGGTAGCGCTCCAGGTACTTCTACTGAACCGTCCGAA GGTAGCGCACCAGGTACTTCTACCGAACCGTCCGAAGGCAGCG CTCCAGGTACCTCTACTGAACCTTCCGAGGGCAGCGCTCCAGGT ACCTCTACCGAACCTTCTGAAGGTAGCGCACCAGGTACTTCTAC CGAACCGTCCGAGGGTAGCGCACCAGGTAGCCCAGCAGGTTCT CCTACCTCCACCGAGGAAGGTACTTCTACCGAACCGTCCGAGG GTAGCGCACCAGGTACCTCTGAAAGCGCAACTCCTGAGTCTGG CCCAGGTAGCGAACCTGCTACCTCCGGCTCTGAGACTCCAGGT AACCTCTGAAAGCGCAACCCCGGAATCTGGTCAGGTAGCGAAC CTGCAACCTCTGGCTCTGAAAACCCCAGGTACCTCTGAAAGCGCT ACTCCTGAATCTGGCCCAGGTACTTCTACTGAACCGTCCGAGGG CAGCGCACCAGGTACTTCTGAAAGCGCTACTCCTGAGTCCGGC CCAGGTAGCCGGCTGCTCTCCGACTTCCACCGAGGAAGGTA GCCCGGCTGGCTCTCCAACTTCTACTGAAGAAGGTAGCCCGGC AGGCTCTCCGACCTCTACTGAGGAAGGTACTTCTGAAAGCGCA ACCCCGGAGTCCGGCCCAGGTACCTCTACCGAACCGTCTGAGG GCAGCGCACCAGGTTTTCCGACTGTCTGCTGTTT GATAATGCTATGCTGCGTGCGCACCGTCTGCACCAGCTGGCCTT TGATACTTACCAGGAATTTGAAGAAGCCTACATTCCTAAAGAGC AGAAGTACTCTTTCCTGCAAAACCCACAGACTTCTCTCTGCTTC AGCGAATCTATTCCGACGCCTTCCAATCGCGAGGAAACTCAGC AAAAGTCCAATCTGGAACTACTCCGCATTTCTCTGCTTCTGATT CAGAGCTGGCTAGAACCAGTGCAATTTCTGCGTTCCGTCTTCGC CAATAGCCTAGTTTATGGCGCATCCGACAGCAACGTATACGAT CTCCTGAAAGATCTCGAGGAAGGCATTCAGACCCTGATGGGTC GTCTCGAGGATGGCTCTCCGCGTACTGGTCAGATCTTCAAGCAG ACTTACTCTAAATTTGATACTAACAGCCACAATGACGATGCGCT TCTAAAAAACTATGGTCTGCTGTATTGTTTCGTAAAGATATGG ACAAAGTTGAAACTTTCCTGCGTATTGTTCAGTGTCGTTCCGTT GAGGGCAGCTGTGGTTTCTAAGGTGGTAGCGAACCGGCAACTT CCGGCTCTGAAACCCCAGGTACTTCTGAAAGCGCTACTCCTGAG TCTGGCCCAGGTAGCGAACCTGCTACCTCTGGCTCTGAAACCCC AGGTAGCCCGGCAGGCTCTCCGACTTCCACCGAGGAAGGTACC TCTACTGAACCTTCTGAGGGTAGCGCTCCAGGTAGCGAACCGG CAACCTCTGGCTCTGAAACCCCAGGTAGCGAACCTGCTACCTCC GGCTCTGAAACTCCAGGTAGCGAACCGGCTACTTCCGGTTCTGA AACTCCAGGTACCTCTACCGAACCTTCCGAAGGCAGCGCACCA GGTACTTCTGAAAGCGCAACCCCTGAATCCGGTCCAGGTAGCG AACCGGCTACTTCTGGCTCTGAGACTCCAGGTACTTCTACCGAA CCGTCCGAAGGTAGCGCACCA | |
| AD836-hGH-AE144 | GSSESGSSEGGPGSS ESGSSEGGPGESPGG SSGSESGSGGEPSES GSSGESPGGSSGSES GESPGGSSGSESGES ESGSSEGGPGSSESG SSEGGPGSSESGSSE GGPGESPGGSSGSES GESPGGSSGSESGES PGGSSGSESGSSESG | 747 | GGTTCCTCTGAAAGCGGTTCTTCCGAAGGTGGTCCAGGTTCCTC TGAAAGCGGTTCTTCTGAGGGTGGTCCAGGTGAATCTCCGGGT GGCTCCAGCGGTTCCGAGTCAGGTTCTGGTGGCGAACCTTCCGA GTCTGGTAGCTCAGGTGAATCTCCGGGTGGTTCTAGCGGTTCCG AGTCAGGTGAATCTCCGGGTGGTTCTGGTTCTGAGTCAGGT TCCTCCGAAAGCGGTTCTTCTGAGGGCGGTCCAGGTTCCTCCGA AAGCGGTTCTTCCGAGGGCGGTCCAGGTTCTTCTGAAAGCGGTT CTTCCGAGGGCGGTCCAGGTGAATCTCCTGGTGGTTCCAGCGGT TCCGAGTCAGGTGAATCTCCAGGTGGCTCTAGCGGTTCCGAGTC AGGTGAATCTCCTGGTGGTTCTAGCGGTTCTGAATCAGGTTCCT | 748 |

TABLE 36-continued

Exemplary GHXTEN comprising growth hormones and two XTEN sequences

| GHXTEN Name* | Amino Acid Sequence | SEQ ID NO: | DNA Nucleotide Sequence | SEQ ID NO: |
|---|---|---|---|---|
| | SSEGGPGSSESGSSE | | CCGAAAGCGGTTCTTCTGAGGGCGGTCCAGGTTCCTCCGAAAG | |
| | GGPGSSESGSSEGGP | | CGGTTCTTCCGAGGCGGTCCAGGTTCTTCTGAAAGCGGTTCTT | |
| | GSSESGSSEGGPGSS | | CCGAGGGCGGTCCAGGTTCCTCTGAAAGCGGTTCTTCTGAGGG | |
| | ESGSSEGGPGSSESG | | CGGTCCAGGTTCTTCCGAAAGCGGTTCTTCCGAGGGCGGTCCAG | |
| | SSEGGPGSSGGEPSES | | GTTCTTCCGAAAGCGGTTCTTCGAAGGCGGTCCAGGTTCTGGT | |
| | GSSGESPGGSSGSES | | GGCGAACCGTCCGAGTCTGGTAGCTCAGGTGAATCTCCGGGTG | |
| | GESPGGSSGSESGSG | | GCTCTAGCGGTTCCGAGTCAGGTGAATCTCCTGGTGGTTCCAGC | |
| | GEPSESGSSGSEGSS | | GGTTCCGAGTCAGGTTCCGGTGGCGAACCGTCCGAATCTGGTA | |
| | GPGESSGSSESGSSE | | GCTCAGGTAGCGAAGGTTCTTCTGGTCCAGGCGAATCTTCAGGT | |
| | GGPGSGGEPSESGSS | | TCCTCTGAAAGCGGTTCTTCTGAGGGCGGTCCAGGTTCCGGTGG | |
| | GSEGSSGPGESSGSS | | CGAACCGTCCGAATCTGGTAGCTCAGGTAGCGAAGGTTCTTCTG | |
| | ESGSSEGGPGSGGEP | | GTCCAGGCGAATCTTCAGGTTCCTCTGAAAGCGGTTCTTCTGAG | |
| | SESGSSGESPGGSSG | | GGCGGTCCAGGTTCCGGTGGCGAACCTTCCGAATCTGGTAGCTC | |
| | SESGSSGEPSESGSS | | AGGTGAATCTCCGGGTGGTTCTAGCGGTTCTGAGTCAGGTTCTG | |
| | GSGGEPSESGSSGSS | | GTGGTGAACCTTCCGAGTCTGGTAGCTCAGGTTCTGGTGGCGAA | |
| | ESGSSEGGPGSGGEP | | CCATCCGAGTCTGGTAGCTCAGGTTCTTCCGAAAGCGGTTCTTC | |
| | SESGSSGSGGEPSES | | CGAAGGCGGTCCAGGTTCTGGTGGTGAACCGTCCGAATCTGGT | |
| | GSSGSEGSSGPGESS | | AGCTCAGGTTCTGGTGGCGAACCATCCGAATCTGGTAGCTCAG | |
| | GESPGGSSGSESGSE | | GTAGCGAAGGTTCTTCTGGTCCTGGCGAATCTTCAGGTGAATCT | |
| | GSSGPGESSGSEGSS | | CCAGGTGGCTCTAGCGGTTCCGAATCAGGTAGCGAAGGTTCTTC | |
| | GPGESSGSGGEPSES | | CGGTCCAGGTGAATCTTCAGGTAGCGAAGGTTCTTCTGGTCCTG | |
| | GSSGSSESGSSEGGP | | GTGAATCCTCAGGTTCCGGTGGCGAACCATCTGAATCTGGTAGC | |
| | GSSESGSSEGGPGES | | TCAGGTTCCTCTGAAAGCGGTTCTTCCGAAGGTGGTCCAGGTTC | |
| | PGGSSGSESGGGEP | | CTCTGAAAGCGGTTCTTCTGAGGGTGGTCCAGGTGAATCTCCGG | |
| | SESGSGSEGSSGPG | | GTGGCTCCAGCGGTTCCGAGTCAGGTTCTGGTGGCGAACCATCC | |
| | ESSGESPGGSSGSES | | GAATCTGGTAGCTCAGGTAGCGAAGGTTCTTCTGGTCCTGGCGA | |
| | GSEGSSGPGSSESGS | | ATCTTCAGGTGAATCTCCAGGTGGCTCTAGCGGTTCCGAATCAG | |
| | SEGGPGSGGEPSESG | | GTAGCGAAGGTTCTTCCGGTCCaGGTTCCTCTGAAAGCGGTTCT | |
| | SSGEGSSSGPGESSG | | TCTGAGGGCGGTCCAGGTTCTGGTGGCGAACCATCTGAATCTG | |
| | SEGSSGPGESSGSEG | | GTAGCTCAGGTAGCGAAGGTTCTTCCGGTCCGGGTGAATCTTCA | |
| | SSGPGESSGSGGEPS | | GGTAGCGAAGGTTCTTCCGGTCCAGGTGAATCTTCAGGTAGCG | |
| | ESGSSGSGEPSESG | | AAGGTTCTTCTGGTCCTGGTGAATCCTCAGGTTCCGGTGGCGAA | |
| | SSGESPGGSSGSESG | | CCATCTGAATCTGGTAGCTCAGGTTCTGGTGGCGAACCATCCGA | |
| | ESPGGSSESGSSGGG | | ATCTGGTAGCTCAGGTGAATCTCCGGGTGGCTCCAGCGGTTCTG | |
| | EPSESGSSGSEGSSGP | | AATCAGGTGAATCTCCTGGTGGCTCCAGCGGTTCTGAGTCAGGT | |
| | GESSGESPGGSSGSE | | TCTGGTGGCGAACCATCCGAATCTGGTAGCTCAGGTAGCGAAG | |
| | SGSSESGSSEGGPGS | | GTTCTTCTGGTCCTGGCGAATCTTCAGGTGAATCTCCAGGTGGC | |
| | SESGSSEGGPGSSES | | TCTAGCGGTTCCGAATCAGGTTCCTCTGAAAGCGGTTCTTCTGA | |
| | GSSEGGPGSSGGEPSE | | GGGCGGTCCAGGTTCTTCCGAAAGCGGTTCTTCCGAGGGCGGT | |
| | SGSSESGSSEGG | | CCAGGTTCTTCCGAAAGCGGTTCTTCTGAAGGCGGTCCAGGTTC | |
| | PGESPGGSSGSESGS | | TGGTGGCGAACCGTCCGAATCTGGTAGCTCAGGTTCCTCCGAA | |
| | GGEPSESGSSGSSES | | AGCGGTTCTTCTGAAGGTGGTCCAGGTGAATCTCCAGGTGGTTC | |
| | GSSEGGPGESPGGSS | | TAGCGGTTCTGAATCAGGTTCTGGTGGCGAACCGTCCGAATCTG | |
| | GSEGSGGEPSESGS | | GTAGCTCAGGTTCCTCCGAAAGCGGTTCTTCTGAAGGTGGTCCA | |
| | SGESPGGSSGSESGS | | GGTGAATCTCCAGGTGGTTCTAGCGGTTCTGAATCAGGTTCTGG | |
| | GGEPSESGSSGFPTIP | | TGGCGAACCGTCCGAATCTGGTAGCTCAGGTGAATCTCCTGGTG | |
| | LSRLFDNAMLRAHR | | GTTCCAGCGGTTCCGAGTCAGGTTCTGGTGGCGAACCTTCCGAA | |
| | LHQLAFDTYQEFEE | | TCTGGTAGCTCAGGTTTTCCGACTATTCCGCTGTCTCGTCTGTTT | |
| | AYIPKEQKYSFLQNP | | GATAATGCTATGCTGCGTGCGCACCGTCTGCACCAGCTGGCCTT | |
| | QTSLCFSESIPTPSNR | | TGATACTTACCAGGAATTTGAAGAAGCtACATTCCTAAAGAGC | |
| | EETQQKSNLELLRIS | | AGAAGTACTCTTTCCTGCAAAACCCACAGACTTCTCTCTGCTTC | |
| | LLLIQSWLEPVQFLR | | AGCGAATCTATTCCGACGCCTTCCAATGCGAGGAAACTCAGC | |
| | SVFANSLVYGASDS | | AAAAGTCCAATCTGGAACTACTCCGCATTTCTCTGCTTCTGATT | |
| | NVYDLLKDLEEGIQT | | CAGAGCTGGCTAGAACCAGTGCAATTTCTGCGTTCCGTCTTCGC | |
| | LMGRLEDGSPRTGQI | | CAATAGCCTAGTTTATGGCGATCCGACAGCAACGTATACGAT | |
| | FKQTYSKFDTNSHN | | CTCCTGAAAGATCTCGAGGAAGGCATTCAGACCCTGATGGGTC | |
| | DDALLKNYGLLYCF | | GTCTCGAGGATGGCTCTCCGCGTACTGGTCAGATCTTCAAGCAG | |
| | RKDMDKVETFLRIV | | ACTTACTCTAAATTTGATACTAACAGCCACAATGACGATGCGCT | |
| | QCRSVEGSCGFGSE | | TCTAAAAAACTATGGTCTGCTGTATTGTTTTCGTAAAGATATGG | |
| | PATSGSETPGTSESA | | ACAAAGTTGAAACTTTCCTGCGTATTGTTCAGTGTCGTTCCGTT | |
| | TPESGPGSEPATSGS | | GAGGGCAGCTGTGGTTTCTAAGGTGGTAGCGAACCGGCAACTT | |
| | ETPGSPAGSPTSTEE | | CCGGCTCTGAAACCCAGGTACTTCTGAAAGCGCTACTCCTGAG | |
| | GTSTEPSEGSAPGSE | | TCTGGCCCAGGTAGCGAACCTGCTACCTCTGGCTCTGAAACCCC | |
| | PATSGSETPGSEPAT | | AGGTAGCCCGGCAGGCTCTCCGACTTCCACCGAGGAAGGTACC | |
| | SGSETPGSEPATSGS | | TCTACTGAACCTTCTGAGGGTAGCGCTCCAGGTAGCGAACCGG | |
| | ETPGTSTEPSEGSAP | | CAACCTCTGGCTCTGAAACCCCAGGTAGCGAACCTGCTACCTCC | |
| | GTSESATPESGPGSE | | GGCTCTGAAACTCCAGGTAGCGAACCGGCTACTTCCGGTTCTGA | |
| | PATSGSETPGTSTEPS | | AACTCCAGGTACCTCTACCGAACCTTCCGAAGGCAGCGCACCA | |
| | EGSAP | | GGTACTTCTGAAAGCGCAACCCCTGAATCCGGTCCAGGTAGCG | |
| | | | AACCGGCTACTTCGGCTCTGAGACTCCAGGTACTTCTACCGAA | |
| | | | CCGTCCGAAGGTAGCGCACCA | |

TABLE 36-continued

Exemplary GHXTEN comprising growth hormones and two XTEN sequences

| GHXTEN Name* | Amino Acid Sequence | SEQ ID NO: | DNA Nucleotide Sequence | SEQ ID NO: |
|---|---|---|---|---|
| AE864-hGH-AE144 | GSPAGSPTSTEEGTS ESATPESGPGTSTEPS EGSAPGSPAGSPTST EEGTSTEPSEGSAPG TSTEPSEGSAPGTSES ATPESGPGSEPATSG SETPGSEPATSGSETP GSPAGSPTSTEEGTS ESATPESGPGTSTEPS EGSAPGTSTEPSEGS APGSPAGSPTSTEEG TSTEPSEGSAPGTSTE PSEGSAPGTSESATP ESGPGTSTEPSEGSA PGTSESATPESGPGS EPATSGSETPGTSTEP SEGSAPGTSTEPSEG SAPGTSESATPESGP GTSESATPESGPGSP AGSPTSTEEGTSESA TPESGPGSEPATSGS ETPGTSESATPESGP GTSTEPSEGSAPGTS TEPSEGSAPGTSTEPS EGSAPGTSTEPSEGS APGTSTEPSEGSAPG TSTEPSEGSAPGSPA GSPTSTEEGTSTEPSE GSAPGTSESATPESG PGSEPATSGSETPGT SESATPESGPGSEPA TSGSETPGTSESATPE SGPGTSTEPSEGSAP GTSESATPESGPGSP AGSPTSEEGSPAGS PTSTEEGSPAGSPTST EEGTSESATPESGPG TSTEPSEGSAPGTSES ATPESGPGSEPATSG SETPGTSESATPESGP GSEPATSGSETPGTS ESATPESGPGTSTEPS EGSAPGSPAGSPTST EEGTSESATPESGPG SEPATSGSETPGTSES ATPESGPGSPAGSPT STEEGSPAGSPTSTEE GTSTEPSEGSAPGTS ESATPESGPGTSESA TPESGPGTSESATPES GPGSEPATSGSETPG SEPATSGSETPGSPA GSPTSTEEGTSTEPSE GSAPGTSTEPSEGSA PGSEPATSGSETPGT SESATPESGPGTSTEP SEGSAPGFPTIPLSRL FDNAMLRAHRLHQL AFDTYQEFEEAYIPK EQKYSFLQNPQTSLC FSESIPTPSNREETQQ KSNLELLRISLLLIQS WLEPVQFLRSVFAN SLVYGASDSNVYDL LKDLEEGIQTLMGRL EDGSPRTGQIFKQTY SKFDTNSHNDDALL KNYGLLYCFRKDMD KVETFLRIVQCRSVE GSCGFGGSEPATSGS ETPGTSESATPESGP GSEPATSGSETPGSP AGSPTSTEEGTSTEPS | 749 | GGTAGCCCGGCTGGCTCTCCTACCTCTACTGAGGAAGGTACTTC TGAAAGCGCTACTCCTGAGTCTGGTCCAGGTACCTCTACTGAAC CGTCCGAAGGTAGCGCTCCAGGTAGCCCAGCAGGCTCTCCGAC TTCCACTGAGGAAGGTACTTCTACTGAACCTTCCGAAGGCAGC GCACCAGGTACCTCTACTGAACCTTCTGAGGGCAGCGCTCCAG GTACTTCTGAAAGCGCTACCCCGGAATCTGGCCCAGGTAGCGA ACCGGCTACTTCTGGTTCTGAAACCCCAGGTAGCGAACCGGCT ACCTCCGGTTCTGAAACTCCAGGTAGCCCGGCAGGCTCTCCGAC CTCTACTGAGGAAGGTACTTCTGAAAGCGCAACCCCGGAGTCC GGCCCAGGTACCTCTACCGAACGTCTGAGGGCAGCGCACCAG GTACTTCTACCGAACCGTCCGAGGGTAGCGCACCAGGTAGCCC AGCAGGTTCTCCTACCTCCACCGAGGAAGGTACTTCTACCGAAC CGTCCGAGGGTAGCGCACCAGGTACCTCTACTGAACCTTCTGA GGGCAGCGCTACCGAAAGCGCTACCCCGGAGTCC GGTCCAGGTACTTCTACTGAACCGTCCGAAGGTAGCGCACCAG GTACTTCTGAAAGCGCAACCCCTGAATCCGGTCCAGGTAGCGA ACCGGCTACTTCTGGCTCTGAGACTCCAGGTACTTCTACCGAAC CGTCCGAAGGTAGCGCACCAGGTACTTCTGAACCGTCTGA AGGTAGCGCACCAGGTACTTCTGAAAGCGCAACCCCGGAATCC GGCCCAGGTACCTCTGAAAGCGCAACCCCGGAGTCCGGCCCAG GTAGCCCTGCTGGCTCTCCAACCTCCACCGAAGAAGGTACCTCT GAAAGCGCAACCCCTGAATCCGGCCCAGGTAGCGAACCGGCT CCTCCGGTTCTGAAACCCCAGGTACCTCTGAAAGCGCTACTCCG GAGTCTGGCCCAGGTACCTCTACTGAACCGTCTGAGGGTAGCG CTCCAGGTACTTCTACTGAACCGTCCGAAGGTAGCGCACCAGG TACTTCTACCGAACCGTCCGAAGGCAGCGCTCCAGGTACCCTA CTGAACCTTCCGAGGGCAGCGCTCCAGGTACCTCTACCGAACCT TCTGAAGGTAGCGCACCAGGTACTTCTACCGAACCGTCCGAGG GTAGCGCACCAGGTAGCCCAGCAGGTTCTCCTACCTCCACCGA GGAAGGTACTTCTACCGAACCGTCCGAGGGTAGCGCACCAGGT ACCTCTGAAAGCGCAACCTCCTGAGTCTGGCCCAGGTAGCGAAC CTGCTACCTCCGGCTCTGAGACTCCAGGTACCTCTGAAAGCGCA ACCCCGGAATCTGGTCCAGGTAGCGAACCTGCAACCTCTGGCT CTGAAACCCCAGGTACCTCTGAAAGCGCTACTCCTGAATCTGGC CCAGGTACTTCTACTGAACCGTCCGAGGGCAGCGCACCAGCAA CTTCTGAAAGCGCTACTCCTGAGTCCGGCCCAGGTAGCCCGGCT GGCTCTCCGACTTCCACCGAGGAAGGTAGCCCGGCTGGCTCTCC AACTTCTACTGAAGAAGGTAGCCCGGCAGGCTCTCCGACCTCT ACTGAGGAAGGTACTTCTGAAAGCGCAACCCCGGAGTCCGGCC CAGGTACCTCTACCGAACCGTCGAGGGCAGCGCACCAGGTAC CTCTGAAAGCGCAACTCCTGAGTCTGGCCCAGGTAGCGAACCT GCTACCTCCGGCTCTGAGACTCCAGGTACCTCTGAAAGCGCAA CCCCGGAATCTGGTCCAGGTAGCGAACCTGCAACCTCTGGCTCT GAAACCCCAGGTACCTCTGAAAGCGCTACTCCTGAATCTGGCC CAGGTACTTCTACTGAACCGTCCGAGGGCAGCGCACCAGGTAG CCCTGCTGGCTCTCCAACCTCCACCGAAGAAGGTACCTCTGAAA GCGCAACCCCTGAATCCGGCCCAGGTAGCGAACCGGCAACCTC CGGTTCTGAAACCCCAGGTACTTCTGAAAGCGCTACTCCTGAGT CCGGCCCAGGTAGCCCGGCTGGCTCTCCGACTTCCACCGAGGA AGGTAGCCCGGCTGGCTCTCCAACTTCTACTGAAGAAGGTACTT CTACCGAACCTTCCGAGGGCAGCGCACCAGGTACTTCTGAAAG CGCTACCCCTGAGTCCGGCCCAGGTACTTCTGAAAGCGCTACTC CTGAATCCGGTCCAGGTACTTCTGAAAGCGCTACCCCGGAATCT GGCCCAGGTAGCGAACCGGCTACTTCTGGTTCTGAAACCCCAG GTAGCGAACCGGCTACCTCCGGTTCTGAAACTCCAGGTAGCCC AGCAGGCTACCTCCGACTTCCACTGAGGAGGTACTTCTACTGAAC CTTCCGAAGGCAGCGCACCAGGTACCTCTACTGAACCTTCTGAG GGCAGCGCTCAGGTAGCGAACCTGCAACCTCTGGCTCTGAA CCCCAGGTACCTCTGAAAGCGCTACTCCTGAATCTGGCCCAGGT ACTTCTACTGAACCGTCCGAAGGTAGCGCACCAGGTTTCCGAC TATTCCGCTGTCTCGTCTGTTTGATAATGCTATGCTGCGTGCGC ACCGTCTGCACCAGCTGGCCTTTGACTTACCAGGAATTTGAA GAAGCcTACATTCCTAAAGAGCAGAAGTACTCTTTCCTGCAAAA CCCACAGACTTCTCTCTGCTTCAGCGAATCTATTCCGACGCCTT CCAATCGCGAGGAAACTCAGCAAAAGTCCAATCTGGAACTACT CCGCATTTCTCTGCTTCTGATTCAGAGCTGGCTAGAACCAGTGC AATTTCTGCGTTCCGTCTTCGCCAATAGCCTAGTTTATGGCGCA TCCGACAGCAACGTATACGATCTCCTGAAAGATCTCGAGGAA GCATTCAGACCCTGATGGGTCGTCTCGAGGATGGCTCCGCGT ACTGGTCAGATCTTCAAGCAGACTTACTCTAAATTTGATACTAA CAGCCACAATGACGATGCGCTTCTAAAAAACATGGTCTGCTGT ATTGTTTTCGTAAAGATATGGACAAAGTTGAAACCTTCCTGCGT ATTGTTCAGTGTCGTTCCGTTGAGGGCAGCTGTGGTTTCTAAGG | 750 |

TABLE 36-continued

Exemplary GHXTEN comprising growth hormones and two XTEN sequences

| GHXTEN Name* | Amino Acid Sequence | SEQ ID NO: | DNA Nucleotide Sequence | SEQ ID NO: |
|---|---|---|---|---|
| | EGSAPGSEPATSGSE TPGSEPATSGSETPG SEPATSGSETPGTSTE PSEGSAPGTSESATP ESGPGSEPATSGSET PGTSTEPSEGSAP | | TGGTAGCGAACCGGCAACTTCCGGCTCTGAAACCCCAGGTACT TCTGAAAGCGCTACTCCTGAGTCTGGCCCAGGTAGCGAACCTG CTACCTCTGGCTCTGAAACCCCAGGTAGCCCGGCAGGCTCTCCG ACTTCCACCGAGGAAGGTACCTCTACTGAACCTTCTGAGGGTA GCGCTCCAGGTAGCGAACCGGCAACCTCTGGCTCTGAAACCCC AGGTAGCGAACCTGCTACCTCCGGCTCTGAAACTCCAGGTAGC GAACCGGCTACTTCCGGTTCTGAAACTCCAGGTACCTCTACCGA ACCTTCCGAAGGCAGCGCACCAGGTACTTCTGAAAGCGCAACC CCTGAATCCGGTCCAGGTAGCGAACCGGCTACTTCTGGCTCTGA GACTCCAGGTACTTCTACCGAACCGTCCGAAGGTAGCGCACCA | |
| AF864- hGH- AE144 | GSTSESPSGTAPGTSP SGESSTAPGSTSESPS GTAPGSTSESPSGTA PGTSTPESGSASPGTS TPESGSASPGSTSESP SGTAPGSTSESPSGT APGTSPSGESSTAPG STSESPSGTAPGTSPS GESSTAPGTSPSGESS TAPGSTSSTAESPGP GTSPSGESSTAPGTSP SGESSTAPGSTSSTA ESPGPGTSTPESGSAS PGTSTPESGSASPGST SESPSGTAPGSTSESP SGTAPGTSTPESGSA SPGSTSSTAESPGPGT STPESGSASPGSTSES PSGTAPGTSPSGESST APGSTSSTAESPGPG TSPSGESSTAPGTSTP ESGSASPGSTSSTAES PGPGSTSSTAESPGP GSTSSTAESPGPGSTS STAESPGPGTSPSGES STAPGSTSESPSGTAP GSTSESPSGTAPGTS TPESGPXXXGASASG APSTXXXXSESPSGT APGSTSESPSGTAPG STSESPSGTAPGSTSE SPSGTAPGSTSESPSG TAPGSTSESPSGTAP GTSTPESGSASPGTSP SGESSTAPGTSPSGES STAPGSTSSTAESPGP GTSPSGESSTAPGTS TPESGSASPGSTSESP SGTAPGSTSESPSGT APGTSPSGESSTAPG STSESPSGTAPGTSTP ESGSASPGTSTPESGS ASPGSTSESPSGTAP GTSTPESGSASPGSTS STAESPGPGSTSESPS GTAPGSTSESPSGTA PGTSPSGESSTAPGST SSTAESPGPGTSPSGE SSTAPGTSTPESGSAS PGTSPSGESSTAPGTS PSGESSTAPGTSPSGE SSTAPGSTSSTAESPG PGSTSSTAESPGPGTS PSGESSTAPGSSPSAS TGTGPGSSTPSGATG SPGSSTPSGATGSPG FPTIPLSRLFDNAML RAHRLHQLAFDTYQ EFEEAYIPKEQKYSF LQNPQTSLCFSESIPT PSNREETQQKSNLEL LRISLLLIQSWLEPVQ FLRSVFANSLVYGAS | 751 | GGTTCTACCAGCGAATCTCCTTCTGGCACCGCTCCAGGTACCTC TCCTAGCGGCGAATCTTCTACCGCTCCAGGTTCTACTAGCGAAT CTCCTTCTGGCACTGCACCAGGTTCTACTAGCGAATCCCCGTCT GGTACTGCTCCAGGTACTTCTACTCCTGAAAGCGGTTCCGCTTC TCCAGGTACCTCTACTCCGAAAGCGGTTCTGCATCTCCAGGTT CTACCAGCGAATCTCCTTCTGGCACCGCTCCAGGTTCTACTAGC GAATCCCCGTCTGGTACCGCACCAGGTACTTCTCCTAGCGGCGA ATCTTCTACCGCCCAGGTTCTACTAGCGAATCTCCGTCTGGCA CTGCTCCAGGTACTTCTCCTAGCGGTGAATCTTCTACCGCTCCA GGTACTTCCCTAGCGGCGAATCTTCTACCGCTCCAGGTTCTAC TAGCTCTACTGCAGAATCTCCGGGCCCAGGTACCTCTCCTAGCG GTGAATCTTCTACCGCTCCAGGTACTTCTCCGAGCGGTGAATCT TCTACCGCTCCAGGTTCTACTAGCTCTACTGCAGAATCTCCTGG CCCAGGTACCTCTACTCCGGAAAGCGGCTCTGCATCTCCAGGTA CTTCTACCCCTGAAAGCGGTTCTGCATCTCCAGGTTCTACTAGC GAATCTCCTTCTGGCACTGCACCAGGTTCTACCAGCGAATCTCC GTCTGGCACTGCACCAGGTACCTCTACCCCTG AAAGCGGTTCCG CTTCTCCAGGTTCTACCAGCTCTACCGCAGAATCTCCTGGTCCA GGTACCTCTACTCCGGAAAGCGGCTCTGCATCTCCAGGTTCTAC TAGCGAATCTCCTTCTGGCACTGCACCAGGTACTTCTCCGAGCG GTGAATCTTCTACCGCTCCAGGTTCTACTAGCTCTACCGCTGAA TCTCCGGGCCCAGGTACTTCTCCGAGCGGTGAATCTTCTACTGC TCTACTGCTGAATCTCCTGGCCCAGGTTCTACTAGCTCTACTGC TGAATCTCCGGGTCCAGGTTCTACCAGCTCTACTGCTGAATCTC CTGGTCCAGGTACCTCCCCGAGCGGTGAATCTTCTACTGCACCA GGTTCTACTAGCGAATCTCCTTCTGGCACTGCACCAGGTTCTAC CAGCGAATCTCCGTCTGGCACTGCACCAGGTACCTCTACCCCTG AAAGCGGTCCXXXXXXXXXXXXTGCAAGCGCAAGCGGCCGCGC CAAGCACGGGAXXXXXXXXXTAGCGAATCTCCTTCTGGTACCGC TCCAGGTTCTACCAGCGAATCCCCGTCTGGTACTGCTCCAGGTT CTACCAGCGAATCCCTTCTGGTACTGCACCAGGTTCTACTAGC GAATCTCCTTCTGGTACCGCTCCAGGTTCTACCAGCGAATCCCC GTCTGGTACTGCTCCAGGTTCTACCAGCGAATCTCCTTCTGGTA CTGCACCAGGTACTTCTACTCCGGAAAGCGGTTCCGCATCTCCA GGTACTTCTCCTAGCGGTGAATCTTCTACTGCTCCAGGTACCTC TCCTAGCGGCGAATCTTCTACTGCTCCAGGTTCTACCAGCGAAT CTCCGGGTCCAGGTACTTCCCCGAGCGGTGAATCT TCTACTGCACCAGGTACTTCTACTCCGAAAGCGGTTCCGCTTC TCCAGGTTCTACCAGCGAATCTCCTTCTGGCACCGCTCCAGGT TCTACCAGCGAATCCCCGTCTGGTACCGCACCAGGTACTTCTCCT AGCGGCGAATCTTCTACCGCACCAGGTTCTACTAGCGAATCCCC GTCTGGTACCGCACCAGGTACTTCTACCCCGGAAAGCGGCTCTG CTTCTCCAGGTACTTCTACCCCGGAAAGCGGCTCCGCATCTCCA GGTTCTACTAGCGAATCTCCTTCTGGTACCGCTCCAGGTACTTC TACCCCTGAAAGCGGCTCCGCTTCTCCAGGTTCCACTAGCTCTA CCGCTGAATCTCCGGGTCCAGGTTCTACCAGCGAATCTCCTTCT GGCACCGCTCCAGGTTCTACTAGCGAATCCCCGTCTGGTACCGC ACCAGGTACTTCTCCTAGCGGCGAATCTTCTACCGCACCAGGTT CTACCAGCTCTACTGCTGAATCTCCGGGTCCAGGTACTTCCCCG AGCGGTGAATCTTCTACTGCACCAGGTACTTCTACTCCGGAAAG CGGTTCCGCTTCTCCAGGTACCTCCCCTAGCGGCGAATCTTCTA CTGCTCCAGGTACTTCTCCTAGCGGCGAATCTTCTACCGCTCCA GGTACCTCCCTAGCGGTGAATCTTCTACCGCACCAGGTTCTAC TAGCTCTACTGCTGAATCCGGGTCCAGGTTCTACCAGCTCTA CTGCTGAATCTCCTGGTCCAGGTACCTCCCCGAGCGGTGAATCT TCTACTGCACCAGGTTCTAGCCCTTCTCACCGGTCAC CCAGGTAGCTCTACCCGTCTGGTGCAACTGGCTCTCCAGGTA GCTACTCCGTCTGGTGCAACCGGCTCCCAGGTTTTCCGACT ATTCCGCTGTCTCGTCTGTTTGATAATGCTATGCTGCGTGCGCA CCGTCTGCACCAGCTGGCCTTTGATACTTACCAGGAATTTGAAG AAGCCTACATTCCTAAAGAGCAGAAGTACTCTTTCCTGCAAAAC | 752 |

TABLE 36-continued

Exemplary GHXTEN comprising growth hormones and two XTEN sequences

| GHXTEN Name* | Amino Acid Sequence | SEQ ID NO: | DNA Nucleotide Sequence | SEQ ID NO: |
|---|---|---|---|---|
| | DSNVYDLLKDLEEGI QTLMGRLEDGSPRT GQIFKQTYSKFDTNS HNDDALLKNYGLLY CFRKDMDKVETFLRI VQCRSVEGSCGFGG SEPATSGSETPGTSES ATPESGPGSEPATSG SETPGSPAGSPTSTEE GTSTEPSEGSAPGSE PATSGSETPGSEPAT SGSETPGSEPATSGS ETPGTSTEPSEGSAP GTSESATPESGPGSE PATSGSETPGTSTEPS EGSAP | | CCACAGACTTCTCTCTGCTTCAGCGAATCTATTCCGACGCCTTC CAATCGCGAGGAAACTCAGCAAAAGTCCAATCTGGAACTACTC CGCATTTCTCTGCTTCTGATTCAGAGCTGGCTAGAACCAGTGCA ATTTCTGCGTTCCGTCTTCGCCAATAGCCTAGTTTATGGCGCAT CCGACAGCAACGTATACGATCTCCTGAAAGATCTCGAGGAAGG CATTCAGACCCTGATGGGTCGTCTCGAGGATGGCTCTCCGCGTA CTGGTCAGATCTTCAAGCAGACTTACTCTAAATTTGATACTAAC AGCCACAATGACGATGCGCTTCAAAAAACTATGGTCTGCTGT ATTGTTTTCGTAAAGATATGGACAAAGTTGAAACCTTCCTGCGT ATTGTTCAGTGTCGTTCCGTTGAGGGCAGCTGTGGTTTCTAAGG TGGTAGCGAACCGGCAACTTCCGGCTCTGAAACCCCAGGTACT TCTGAAAGCGCTACTCCTGAGTCTGGCCCAGGTAGCGAACCTG CTACCTCTGGCTCTGAAACCCCAGGTAGCCCGGCAGGCTCTCCG ACTTCCACCGAGGAAGGTACCTCTACTGAACCTTCTGAGGGTA GCGCTCCAGGTAGCGAACCGGCAACCTCTGGCTCTGAAACCCC AGGTAGCGAACCTGCTACCTCCGGCTCTGAAACTCCAGGTAGC GAACCGGCTACTTCCGGTTCTGAAACTCCAGGTACCTCTACCGA ACCTTCCGAAGGCAGCGCACCAGGTACTTCTGAAAGCGCAACC CCTGAATCCGGTCCAGGTAGCGAACCGGCTACTTCTGGCTCTGA GACTCCAGGTACTTCTACCGAACCGTCCGAAGGTAGCGCACCA | |
| AG864-hGH-AE144 | GASPGTSSTGSPGSS PSASTGTGPGSSPSA STGTGPGTPGSGTAS SSPGSSTPSGATGSP GSNPSASTGTGPGAS PGTSSTGSPGPTPGSG TASSSPGSSTPSGAT GSPGTPGSGTASSSP GASPGTSSTGSPGAS PGTSSTGSPGPTPGSG TASSSPGSSTPSGAT GSPGASPGTSSTGSP GTPGSGTASSSPGSS TPSGATGSPGSNPSA STGTGPGSSPSASTG TGPGSSTPSGATGSP GSSTPSGATGSPGAS PGTSSTGSPGASPGT SSTGSPGASPGTSST GSPGTPGSGTASSSP GASPGTSSTGSPGAS PGTSSTGSPGASPGT SSTGSPGSSPSASTGT GPGTPGSGTASSSPG ASPGTSSTGSPGASP GTSSTGSPGASPGTS STGSPGSSTPSGATG SPGSSTPSGATGSPG ASPGTSSTGSPGTPG SGTASSSPGSSTPSG ATGSPGSSTPSGATG SPGSSTPSGATGSPG SSPSASTGTGPGASP GTSSTGSPGASPGTS STGSPGTPGSGTASS SPGASPGTSSTGSPG ASPGTSSTGSPGASP GTSSTGSPGASPGTS STGSPGTPGSGTASS SPGSSTPSGATGSPG TPGSGTASSSPGSSTP SGATGSPGTPGSTA SSSPGSSTPSGATGSP GSSTPSGATGSPGSS PSASTGTGPGSSPSA STGTGPGASPGTSST GSPGTPGSGTASSSP GSSTPSGATGSPGSS PSASTGTGPGSSPSA STGTGPGASPGTSST GSPGASPGTSSTGSP GSSTPSGATGSPGSS PSASTGTGPGASPGT | 753 | GGTGCTTCCCCGGGCACCAGCTCTACTGGTTCTCCAGGTTCTAG CCCGTCTGCTTCTACTGGTACTGGTCCAGGTTCTAGCCCTTCTGC TTCCACTGGTACTGGTCCAGGTACCCCGGGTAGCGGTACCGCTT CTTCTTCTCCAGGTAGCTCTACTCCGTCTGGTGCTACCGGCTCTC CAGGTTCTAACCCTTCTGCATCCACCGGTACCGGCCCAGGTGCT TCTCCGGGCACCAGCTCTACTGGTTCTCCAGGTACCCCGGGCAG CGGTACCGCATCTTCTTCTCCAGGTAGCTCTACTCCTTCTGGTGC AACTGGTTCTCCAGGTACTCCTGGCAGCGGTACCGCTTCTTCTT CTCCAGGTGCTTCTCCTGGTACTAGCTCTACTGGTTCTCCAGGT GCTTCTCCGGGCACTAGCTCTACTGGTTCTCCAGGTACCCCGGG TAGCGGTACTGCTTCTTCCTCTCCAGGTAGCTCTACCCCTTCTGG TGCAACCGGCTCTCCAGGTGCTTCTCCGGGCACCAGCTCTACCG GTTCTCCAGGTACCCCGGGTAGCGGTACCGCTTCTTCTTCTCCA GGTAGCTCTACTCCGTCTGGTGCTACCGGCTCTCCAGGTTCTAA CCCTTCTGCATCCACCGGTACCGGCCCAGGTAGCTTAGCCCTTCTG CTTCCACCGGTACTGGCCAGGTAGCTCTACTCCTTCTGGTGCT ACCGGCTCTCCAGGTAGCTCTACTCCTTCTGGTGCAACTGGCTC TCCAGGTGCATCTCCGGGCACTAGCTCTACTGGTTCTCCAGGTG CATCCCCTGGCACTAGCTCTACTGGTTCTCCAGGTGCTTCTCCT GGTACCAGCTCTACTGGTTCTCCAGGTACTCCTGGCAGCGGTAC CGCTTCTTCTTCTCCAGGTGCTTCTCCTGGTACTAGCTCTACTGG TTCTCCAGGTGCTTCTCCGGGCACTAGCTCTACTGGTTCTCCAG GTGCTTCCCCGGGCACTAGCTCTACCGGTTCTCCAGGTTCTAGC CCTTCTGCATCTACTGGTACTGGCCCAGGTACTCCGGGCAGCGG TACTGCTTCTTCCTCTCAGGTGCATCTCCGGGCACTAGCTCTA CTGGTTCTCCAGGTGCATCCCCTGGCACTAGCTCTACTGGTTCT CCAGGTGCTTCTCCTGGTACTAGCTCTACTGGTTCTCCAGGTGC ATCCCCGGGCACCAGCTCTACTGGTTCTCCAGGTGCATCTCCGG GCACTAGCTCTACTGGTTCTCCAGGTGCATCCCTGGCACTAGC TCTACTGGTTCTCCAGGTGCTTCTCCTGGTACCAGCTCTACTGGT TCTCCAGGTACCCCTGGCAGCGGTACTGCTTCTTCCTCTCCAGG TAGCTCTACTCCGTCTGGTGCTACCGGTTCTCCAGGTACCCCGG GTAGCGGTACCGCATCTTCTTCTCCAGGTAGCTCTACCCCGTCT GGTGCTACTGGTTCTCCAGGTACTCCGGGCAGCGGTACTGCTTC TTCCTCTCCAGGTAGCTCTACCCCGTCTGGTGCTACTGGCTCCCAGGTTCTA GCCCTTCTGCATCCACCGGTACCGGTCCAGGTTCTAGCCCCGTCT GCATCTACTGGTACTGGTCCAGGTGCATCCCGGGCACTAGCTC TACCGGTTCTCCAGGTGCTTAGCCCTTCTGGTGCTACTGGTTCTCCC TCCAGGTAGCTCTACCCCTTCTGGTGCTACTGGTTCTCCAGGTTC AGCCCTTCTGCATCCACCGGTACCGGCCCAGGTTCTAGCCCGT CTGCTTCTACCGGTACTGGTCCAGGTGCTTCTCCGGGTACTAGC TCTACTGGTTCTCCAGGTGCATCCTGGTACTAGCTCTACTGG TTCTCCAGGTAGCTCTACTCCGTCTGGTGCAACCGGCTCTCCA | 754 |

TABLE 36-continued

Exemplary GHXTEN comprising growth hormones and two XTEN sequences

| GHXTEN Name* | Amino Acid Sequence | SEQ ID NO: | DNA Nucleotide Sequence | SEQ ID NO: |
|---|---|---|---|---|
| | SSTGSPGSSPSASTGT GPGTPGSGTASSSPG SSTPSGATGSPGSSTP SGATGSPGASPGTSS TGSPGFPTIPLSRLFD NAMLRAHRLHQLAF DTYQEFEEAYIPKEQ KYSFLQNPQTSLCFS ESIPTPSNREETQQKS NLELLRISLLLIQSWL EPVQFLRSVFANSLV YGASDSNVYDLLKD LEEGIQTLMGRLEDG SPRTGQIFKQTYSKF DTNSHNDDALLKNY GLLYCFRKDMDKVE TFLRIVQCRSVEGSC GFGGSEPATSGSETP GTSESATPESGPGSE PATSGSETPGSPAGS PTSTEEGTSTEPSEGS APGSEPATSGSETPG SEPATSGSETPGSEP ATSGSETPGTSTEPSE GSAPGTSESATPESG PGSEPATSGSETPGT STEPSEGSAP | | GTTCTAGCCCTTCTGCATCTACCGGTACTGGTCCAGGTGCATCC CCTGGTACCAGCTCTACCGGTTCTCCAGGTTCTAGCCCTTCTGC TTCTACCGGTACCGGTCCAGGTACCCCTGGCAGCGGTACCGCAT CTTCCTCTCCAGGTAGCTCTACTCCGTCTGGTGCAACCGGTTCC CCAGGTAGCTCTACTCCTTCTGGTGCTACTGGCTCCCCAGGTGC ATCCCCTGGCACCAGCTCTACCGGTTCTCCAGGTTTTCCGACTA TTCCGCTGTCTCGTCTGTTTGATAATGCTATGCTGCGTGCGCAC CGTCTGCACCAGCTGGCCTTTGATACTTACCAGGAATTTGAAGA AGCcTACATTCCTAAAGAGCAGAAGTACTCTTTCCTGCAAAACC CACAGACTTCTCTGCTTCAGCGAATCTATTCCGACGCCTTCC AATCGCGAGGAAACTCAGCAAAAGTCCAATCTGGAACTACTCC GCATTTCTCTGCTTCTGATTCAGAGCTGGCTAGAACCAGTGCAA TTTCTGCGTTCCGTCTTCGCCAATAGCCTAGTTTATGGCGCATCC GACAGCAACGTATACGATCTCCTGAAAGATCTCGAGGAAGGCA TTCAGACCCTGATGGGTCGTCTCGAGGATGGCTCTCCGTGTACT GGTCAGATCTTCAAGCAGACTTACTCTAAATTTGATACTAACAG CCACAATGACGATGCGCTTCTAAAAAACTATGGTCTGCTGTATT GTTTTCGTAAAGATATGGACAAAGTTGAAACCTTCCTGCGTATT GTTCAGTGTCGTTCCGTTGAGGGCAGCTGTGGTTTCTAAGGTGG TAGCGAACCGGCAACTTCCGGCTCTGAAACCCAGGTACTTCTG AAAAGCGCTACTCCTGAGTCTGGCCCAGGTAGCGAACCTGCTAC CTCTGGCTCTGAAACCCCAGGTAGCCCGGCAGGCTCTCCGACTT CCACCGAGGAAGGTACCTCTACTGAACCTTCTGAGGGTAGCGC TCCAGGTAGCGAACCGGCAACCTCTGGCTCTGAAACCCCAGGT AGCGAACCTGCTACCTCCGGCTCTGAAACTCCAGGTAGCGAAC CGGCTACTTCCGGTTCTGAAACTCCAGGTACCTCTACCGAACCT TCCGAAGGCAGCGCACCAGGTACTTCTGAAAGCGCAACCCCTG AATCCGGTCCAGGTAGCGAACCGGCTACTTCTGGCTCTGAGACT CCAGGTACTTCTACCGAACCGTCCGAAGGTAGCGCACCA | |
| AM875-hGH-AE144 | GTSTEPSEGSAPGSE PATSGSETPGSPAGS PTSTEEGSTSSTAESP GPGTSTPESGSASPG STSESPSGTAPGSTSE SPSGTAPGTSTPESGS ASPGTSTPESGSASP GSEPATSGSETPGTS ESATPESGPGSPAGS PTSTEEGTSTEPSEGS APGTSESATPESGPG TSTEPSEGSAPGTSTE PSEGSAPGSPAGSPT STEEGTSTEPSEGSAP GTSTEPSEGSAPGTS ESATPESGPGTSESA TPESGPGTSTEPSEGS APGTSTEPSEGSAPG TSESATPESGPGTSTE PSEGSAPGSEPATSG SETPGSPAGSPTSTEE GSSTPSGATGSPGTP GSGTASSSPGSSTPS GATGSPGTSTEPSEG SAPGTSTEPSEGSAP GSEPATSGSETPGSP AGSPTSTEEGSPAGS PTSTEEGTSTEPSEGS APGASASGAPSTGGT SESATPESGPGSPAG SPTSTEEGSPAGSPTS TEEGSTSSTAESPGP GSTSESPSGTAPGTSP SGESSTAPGTPGSGT ASSSPGSSTPSGATG SPGSSPSASTGTGPG SEPATSGSETPGTSES ATPESGPGSEPATSG SETPGTSSTAESPGP GSTSSTAESPGPGTSP SGESSTAPGSEPATS GSETPGSEPATSGSE TPGTSTEPSEGSAPG STSSTAESPGPGTSTP | 755 | GGTACTTCTACTGAACCGTCTGAAGGCAGCGCACCAGGTAGCG AACCGGCTACTTCCGGTTCTGAAACCCCAGGTAGCCCAGCAGG TTCTCCAACTTCTACTGAAGAAGGTTCTACCAGCTCTACCGCAG AATCTCCTGGTCAGGTACCTCTACTCCGGAAAGCGGCTCTGCA TCTCCAGGTTCTACTAGCGAATCTCCTTCTGGCACTGCACCAGG TTCTACTAGCGAATCCCCGTCTGGTACTGCTCCAGGTACTTCTA CTCCTGAAAGCGGTTCCGCTTCTCCAGGTACCTCTACTCCGGAA AGCGGTTCTGCATCTCCAGGTAGCGAACCGGCAACCTCCGGCT CTGAAACCCCAGGTACCTCTGAAAGCGCTACTCCTGAATCCGG CCCAGGTAGCCCTGCTGGCTCCCCACTGAGGAAGT ACCTCTACTGAACCTTCTGAGGGCAGCGCTCCAGGTACTTCTGA AAGCGCTACCCCGGAGTCCGGTCCAGGTACTTCTACTGAACCGT CCGAAGGTAGCGCACCAGGTACTTCTACCGAACCGTCCGAGGG TAGCGCACCAGGTAGCCCAGCCGGTTCTCCTACCTCCACCGAG GAAGGTACTTCTACCGAACCGTCCGAGGGTAGCGCACCAGGTA CTTCTACCGAACCTTCCGAGGGCAGCGCACCAGGTACTTCTGAA AGCGCTACCCCTGAGTCCGGCCCAGGTACTTCTGAAAGCGCTA CTCCTGAATCCGGTCCAGGTTCTACTGAACCTTCCGAAGGC AGCGCTCCAGGTACCTCTACCGAACCGTCCGAGGGCAGCGCAC CAGGTACTTCTGAAAGCGCAACCCCTGAATCCGGTCCAGGTAC TTCTACTGAACCTTCCGAAGGTAGCGCTCCAGGTAGCGAACCTG CTACTTCTGGTTCTGAAACCCCAGGTAGCCCGGCTGGCTCTCCG ACCTCCACCGAGGAAGGTAGCTCTACCCCGTCTGGTGCTACTGG TTCTCCAGGTACTCCGGGCAGCGGTACTGCTTCTTCCTCTCCAG GTAGCTCTACCCCTTCTGGTGCTACTGGCTCTCCAGGTACCTCT GAACCCGTCCGGGGTAGCGCACCAGGTACCTCTACTGAAC CGTGAGGGTAGCGCTCCAGGTAGCGAACCGGCAACCTCCGG TTCTGAAACTCCAGGTAGCCCTGCTGGCTCTCCGACTTCTACTG AGGAAGGTAGCCCGGCTGGTTCTCCGACTTCTACTGAGGAAGG TACTTCTACCGAACCTTCCGAAGGTAGCGCTCCAGGTGCAAGC GCAAGCGGCGCCCAAGCACCGGCACCAGGTACTTCTGAAAGCGCTA CTCCTGAGTCCGGCCCAGGTAGCCCGGCTGGCTCTCCGACTTCC ACCGAGGAAGGTAGCCCGGCTGGCTCTCCAACTTCTACTGAAG AAGGTTCTACCAGCTCTACCGCTGAATCTCCTGGCCCAGGTTCT ACTAGCGAATCTCCGTCTGGCACCGCACCAGGTACTTCCCCTAG CGGTGAATCTTCTACTGCACCAGGTACCCCTGGCAGCGGTACCG CTTCTTCCTCTCCAGGTAGCTCTACCCCGTCTGGTGCTACTGGCT CTCCAGGTTCTAGCCCGTCTGCATCTACCGGTACCGGCCCAGGT AGCGAACCGGCAACTTCCGGCTCTGAAACTCCAGGTACTTCTG AAAGCGCTACTCCGGAATCCGGCCCAGGTAGCGAACCGGCTAC TTCCGGCTCTGAAACCCCAGGTTCCACCAGCTCTACTGCAGAAT CTCCGGGCCCAGGTTCTACTAGCTCTACTGCAGAATCTCCGGGT CCAGGTACTTCTCCTAGCGGCGAATCTTCTACCGCTCCAGGTAG CGAACCGGCAACCTCTGGCTCTGAAACTCCAGGTAGCGAACCT | 756 |

TABLE 36-continued

Exemplary GHXTEN comprising growth hormones and two XTEN sequences

| GHXTEN Name* | Amino Acid Sequence | SEQ ID NO: | DNA Nucleotide Sequence | SEQ ID NO: |
|---|---|---|---|---|
| | ESGSASPGSTSESPSG TAPGTSTEPSEGSAP GTSTEPSEGSAPGTS TEPSEGSAPGSSTPSG ATGSPGSSPSASTGT GPGASPGTSSTGSPG SEPATSGSETPGTSES ATPESGPGSPAGSPT STEEGSSTPSGATGS PGSSPSASTGTGPGA SPGTSSTGSPGTSESA TPESGPGTSTEPSEGS APGTSTEPSEGSAPG FPTIPLSRLFDNAML RAHRLHQLAFDTYQ EFEEAYIPKEQKYSF LQNPQTSLCFSESIPT PSNREETQQKSNLEL LRISLLLIQSWLEPVQ FLRSVFANSLVYGAS DSNVYDLLKDLEEGI QTLMGRLEDGSPRT GQIFKQTYSKFDTNS HNDDALLKNYGLLY CFRKDMDKVETFLRI VQCRSVEGSCGFGG SEPATSGSETPGTSES ATPESGPGSEPATSG SETPGSPAGSPTSTEE GTSTEPSEGSAPGSE PATSGSETPGSEPAT SGSETPGSEPATSGS ETPGTSTEPSEGSAP GTSESATPESGPGSE PATSGSETPGTSTEPS EGSAP | | GCAACCTCCGGCTCTGAAACCCCAGGTACTTCTACTGAACCTTC TGAGGGCAGCGCACCAGGTTCTACCAGCTCTACCGCAGAATCT CCTGGTCCAGGTACCTCTACTCCGGAAAGCGGCTCTGCATCTCC AGGTTCTACTAGCGAATCTCCTTCTGGCACTGCACCAGGTACTT CTACCGAACCGTCCGAAGGCAGCGCTCCAGGTACCTCTACTGA ACCTTCCGAGGGCAGCGCTCCAGGTACCTCTACCGAACCTTCTG AAGGTAGCGCACCAGGTAGCGCTACTCCGTCTGGTGCAACCGG CTCCCCAGGTTCTAGCCCGTCTGCTTCCACTGGTACTGGCCCAG GTGCTTCCCCGGGCACCAGCTCTACTGGTTCTCCAGGTAGCGAA CCTGCTACCTCCGGTTCTGAAACCCCAGGTACCTCTGAAAGCGC AACTCCGGAGTCTGGTCCAGGTAGCCCTGCAGGTTCTCCTACCT CCACTGAGGAAGGTAGCTCTACTCCGTCTGGTGCAACCGGCTCC CCAGGTTCTAGCCCGTCTGCTTCCACTGGTACTGGCCCAGGTGC TTCCCCGGGCACCAGCTCTACTGGTTCTCCAGGTACCTCTGAAA GCGCTACTCCGGAGTCTGGCCCAGGTACCTCTACTGAACCGTCC GAAGGTAGCGCTCCAGGTACTTCTACTGAACCGTCCGAAGGTA GCGCACCAGGTTTTCCGACTATTCCGCTGTCTCGTCTGTTTGAT AATGCTATGCTGCGTGCGCACCGTCTGCACCAGCTGGCCTTTGA TACTTACCAGGAATTTGAAGAAGCcTACATTCCTAAAGAGCAGA AGTACTCTTTCCTGCAAACCCACAGACTTCTCTCTGCTTCAGC GAATCTATTCCGACGCCTTCCAATGCGAGGAAACTCAGCAAA AGTCCAATCTGGAACTACTCCGCATTTCTCTGCTTCTGATTCAG AGCTGGCTAGAACCAGTGCAATTTCTGCGTTCCGTCTTCGCCAA TAGCCTAGTTTATGGCGCATCCGACAGCAACGTATACGATCTCC TGAAAGATCTCGAGGAAGGCATTCAGACCCTGATGGGTCGTCT CGAGGATGGCTCTCCGCGTACTGGTCAGATCTTCAAGCAGACTT ACTCTAAATTTGATACTAACAGCCACAATGACGATGCGCTCTA AAAAACTATGGTCTGCTGTATTGTTTTCGTAAAGATATGGACAA AGTTGAAACCTTCCTGCGTATTGTTCAGTGTCGTTCCGTTGAGG GCAGCTGTGGTTTCTAAGGTGGTAGCGAACCGGCAACTTCCGG CTCTGAAACCCCAGGTACTTCTGAAAGCGCTACTCCTGAGTCTG GCCCAGGTAGCGAACCTGCTACCTCTGGCTCTGAAACCCCAGG TAGCCCGGCAGGCTCTCCGACTTCCACCGAGGAAGGTACCTCT ACTGAACCTTCTGAGGGTAGCGCTCCAGGTAGCGAACCGGCAA CCTCTGGCTCTGAAACCCCAGGTAGCGAACCTGCTACCTCCGGC TCTGAAACTCCAGGTAGCGAACCGGCTACTTCCGGTTCTGAAAC TCCAGGTACCTCTACCGAACCTTCCGAAGGCAGCGCACCAGGT ACTTCTGAAAGCGCAACCCCTGAATCCGGTCCAGGTAGCGAAC CGGCTACTTCGGCTCTGAGACTCCAGGTACTTCTACCGAACCG TCCGAAGGTAGCGCACCA | |
| AE912-hGH-AE144 | MAEPAGSPTSTEEGT PGSGTASSSPGSSTPS GATGSPGASPGTSST GSPGSPAGSPTSTEE GTSESATPESGPGTS TEPSEGSAPGSPAGS PTSTEEGTSTEPSEGS APGTSTEPSEGSAPG TSESATPESGPGSEP ATSGSETPGSEPATS GSETPGSPAGSPTST EEGTSESATPESGPG TSTEPSEGSAPGTSTE PSEGSAPGSPAGSPT STEEGTSTEPSEGSAP GTSTEPSEGSAPGTS ESATPESGPGTSTEPS EGSAPGTSESATPES GPGSEPATSGSETPG TSTEPSEGSAPGTSTE PSEGSAPGTSESATP ESGPGTSESATPESG PGSPAGSPTSTEEGT SESATPESGPGSEPA TSGSETPGTSESATPE SGPGTSTEPSEGSAP GTSTEPSEGSAPGTS TEPSEGSAPGTSTEPS EGSAPGTSTEPSEGS SPAGSPTSTEEGTSTE PSEGSAPGTSESATP ESGPGSEPATSGSET | 757 | ATGGCTGAACCTGCTGGCTCTCCAACCTCCACTGAGGAAGGTA CCCCGGGTAGCGGTACTGCTTCTTCCTCTCCAGGTAGCTCTACC CCTTCTGGTGCAACCGGCTCTCCAGGTGCTTCTCCGGGCACCAG CTCTACCGGTTCTCCAGGTAGCCCGGCTGGCTCTCCTACCTCTA CTGAGGAAGGTACTTCTGAAAGCGCTACTCCTGAGTCTGGTCCA GGTACCTCTACTGAACCGTCCGAAGGTAGCGCTCCAGGTAGCC CAGCAGGCTCTCCGACTTCCACTGAGGAAGGTACTTCTACTGAA CCTTCCGAAGGCAGCGCACCAGGTACCTCTACTGAACCTTCTGA GGGCAGCGCTCCAGGTACTTCTGAAAGCGCTACCCCGGAATCT GGCCCAGGTAGCGAACCGGCTACTTCTGGTTCTGAAACCCCAG GTAGCGAACCTGCTACCTCCGGTTCTGAAACTCCAGGTAGCCC GGCAGGCTCTCCGACCTCTACTGAGGAAGGTACTTCTGAAAGC GCAACCCCGGAGTCCGGCCCAGGTACCTCTACCGAACCGTCTG AGGGCAGCGCACCAGGTACTTCTACCGAACCGTCCGAGGGTAG CGCACCAGGTAGCCCAGCAGGTTCTCCTACCTCCACCGAGGAA GGTACTTCTACCGAACCGTCCGAGGGTAGCGCACCAGGTACCT CTACTGAACCTTCTGAGGGCAGCGCTCCAGGTACTTCTGAAAGC GCTACCCCGGAGTCCGGTCCAGGTACTTCTACTGAACCGTCCGA AGGTAGCGCACCAGGTACTTCTGAAAGCGCAACCCCTGAATCC GGTCCAGGTAGCGAACCTGCTACCTCTGGCTCTGAGACTCCAG GTACTTCTGAAAGCGCTACCCCGGAGTCCGGTCCAGGTACTTCT ACTGAACCGTCCGAAGGTAGCGCACCAGGTACTTCTGAAAGCG CAACCCCCGGAATCCGGCCCAGGTACCTCTGAAAGCGCAACCCC GGAGTCCGGCCCAGGTAGCCCTGGCTCTCCAACCTCCACCG AAGAAGGTACCTCTGAAAGCGCAACCCCTGAATCCGGCCCAGG TAGCGAACCGGCAACCTCCGGTTCTGAAACCCCAGGTACCTCT GAAAGCGCTACTCCGGAGTCTGGCCCAGGTACCTCTACTGAAC CGTCTGAGGGTAGCGCTCCAGGTACTTCTACTGAACCGTCCGAA GGTAGCGCACCAGGTACTTCTACCGAACCGTCCGAAGGCAGCG CTCCAGGTACCTCTACTGAACCTTCCGAGGGCAGCGCTCCAGGT ACCTCTACCGAACCTTCTGAAGGTAGCGCACCAGGTACTTCTAC CGAACCGTCCGAGGGTAGCGCACCAGGTAGCCCAGCAGGTTCT CCTACCTCCACCGAGGAAGGTACTTCTACCGAACCGTCCGAGG | 758 |

TABLE 36-continued

Exemplary GHXTEN comprising growth hormones and two XTEN sequences

| GHXTEN Name* | Amino Acid Sequence | SEQ ID NO: | DNA Nucleotide Sequence | SEQ ID NO: |
|---|---|---|---|---|
| | PGTSESATPESGPGS EPATSGSETPGTSES ATPESGPGTSTEPSE GSAPGTSESATPESG PGSPAGSPTSEEGSP AGSPTSTEEGSPAGS PTSTEEGTSESATPES GPGTSTEPSEGSAPG TSESATPESGPGSEP ATSGSETPGTSESAT PESGPGSEPATSGSE TPGTSESATPESGPG TSTEPSEGSAPGSPA GSPTSTEEGTSESATP ESGPGSEPATSGSET PGTSESATPESGPGSP AGSPTSTEEGSPAGS PTSTEEGTSTEPSEGS APGTSESATPESGPG TSESATPESGPGTSES ATPESGPGSEPATSG SETPGSEPATSGSETP GSPAGSPTSTEEGTS TEPSEGSAPGTSTEPS EGSAPGSEPATSGSE TPGTSESATPESGPG TSTEPSEGSAPGFPTI PLSRLFDNAMLRAH RLHQLAFDTYQEFEE AYIPKEQKYSFLQNP QTSLCFSESIPTPSNR EETQQKSNLELLRIS LLLIQSWLEPVQFLR SVFANSLVYGASDS NVYDLLKDLEEGIQT LMGRLEDGSPRTGQI FKQTYSKFDTNSHN DDALLKNYGLLYCF RKDMDKVETFLRIV QCRSVEGSCGFGGTS ESATPESGPGTSTEPS EGSAPGTSTEPSEGS APGTSESATPESGPG TSTEPSEGSAPGTSTE PSEGSAPGTSESATP ESGPGTSTEPSEGSA PGTSTEPSEGSAPGT STEPSEGSAPGSPAG SPTSTEEGTSTEPSEG SAPG | | GTAGCGCACCAGGTACCTCTGAAAGCGCAACTCCTGAGTCTGG CCCAGGTAGCGAACCTGCTACCTCCGGCTCTGAGACTCCAGGT ACCTCTGAAAGCGCAACCCCGGAATCTGGTCCAGGTAGCGAAC CTGCAACCTCTGGCTCTGAAACCCCAGGTACCTCTGAAAGCGCT ACTCCTGAATCTGGCCCAGGTACTTCTACTGAACCGTCCGAGGG CAGCGCACCAGGTACTTCTGAAAGCGCTACTCCTGAGTCCGGC CCAGGTAGCCCGGCTGGCTCTCCGACTTCCACCGAGGAAGGTA GCCCGGCTGGCTCTCCAACTTCTACTGAAGAAGGTAGCCCGGC AGGCTCTCCGACCTCTACTGAGGAAGGTACTTCTGAAAGCGCA ACCCCGGAGTCCGGCCCAGGTACCTCTACCGAACCGTCTGAGG GCAGCGCACCAGGTACCTCTGAAAGCGCAACTCCTGAGTCTGG CCCAGGTAGCGAACCTGCTACCTCCGGCTCTGAGACTCCAGGT ACCTCTGAAAGCGCAACCCCGGAATCTGGTCCAGGTAGCGAAC CTGCAACCTCTGGCTCTGAAACCCCAGGTACCTCTGAAAGCGCT ACTCCTGAATCTGGCCCAGGTACTTCTACTGAACCGTCCGAGGG CAGCGCACCAGGTAGCCCTGCTGGCTCTCCAACCTCCACCGAA GAAGGTACCTCTGAAAGCGCAACCCCTGAATCCGGCCCAGGTA GCGAACCGGCAACCTCCGGTTCTGAAACCCCAGGTACTTCTGA AAGCGCTACTCCTGAGTCCGGCCCAGGTAGCCCGGCTGGCTCTC CGACTTCCACCGAGGAAGGTAGCCCGGCTGGCTCTCCAACTTCT ACTGAAGAAGGTACTTCTACCGAACCTTCCGAGGGCAGCGCAC CAGGTACTTCTGAAAGCGCTACCCCTGAGTCCGGCCCAGGTACT TCTGAAAGCGCTACTCCTGAATCCGGTACTTCTCAGGTACTTCTGAAAG CGCTACCCCGGAATCTGGCCCAGGTAGCGAACCGGCTACTTCT GGTTCTGAAACCCCAGGTAGCGAACCGGCTACCTCCGGTTCTG AAACTCCAGGTAGCCCAGCAGGCTCTCCGACTTCCACTGAGGA AGGTACTTCTACTGAACCTTCCGAGGGCAGCGCTCCAGGTAGCGAACCTG CAACCTCTGGCTCTGAAACCCCAGGTACCTCTGAAAGCGCTACT CCTGAATCTGGCCCAGGTACTTCTACTGAACCGTCCGAGGGCA GCGCACCAGGTTTTCCGACTATTCCGCTGTCTCGTCTGTTTGAT AATGCTATGCTGCGTGCGCACCGTCTGCACCAGCTGGCCTTTGA TACTTACCAGGAATTTGAAGAAGCCTACATTCCTAAAGAGCAGA AGTACTCTTTCCTGCAAAACCCACAGACTTCTCTCTGCTTCAGC GAATCTATTCCGACGCCTTCCAATCGCGAGGAAACTCAGCAAA AGTCCAATCTGGAACTACTCCGCATTTCTCTGCTTCTGATTCAG AGCTGGCTAGAACCAGTGCAATTTCTGCGTTCCGTCTTCGCCAA TAGCCTAGTTTATGGCGCATCCGACAGCAACGTATACGATCTCC TGAAAGATCTCGAGGAAGGCATTCAGACCCTGATGGGTCGTCT CGAGGATGGCTCTCCGCGTACTGGTCAGATCTTCAAGCAGACTT ACTCTAAATTTGATACTAACAGCCACAATGACGATGCGCTTCTA AAAAACTATGGTCTGCTGTATTGTTTTCGTAAAGATATGGACAA AGTTGAAACCTTCCTGCGTATTGTTCAGTGTCGTTCCGTTGAGG GCAGCTGTGGTTTCTAAGGTGGTAGCGAACCGGCAACTTCCGG CTCTGAAAACCCCAGGTACTTCTGAAAGCGCTACTCCTGAGTCTG GCCCAGGTAGCGAACCTGCTACCTCTGGCTCTGAAACCCCAGG TAGCCCGGCAGGCTCTCCGACTTCCACCGAGGAAGGTACCTCT ACTGAACCTTCCGAGGGCAGCGCCCAGGTAGCGAACCGGCAA CCTCTGGCTCTGAAACCCCAGGTAGCGAACCTGCTACCTCCGGC TCTGAAACTCCAGGTAGCGAACCGGCTACTTCCGGTTCTGAAAC TCCAGGTACCTCTACCGAACCTTCCGAAGGCAGCGCACCAGGT ACTTCTGAAAGCGCAACCCCTGAATCCGGTCCAGGTAGCGAAC CGGCTACTTCTGAGACTCCAGGTACTTCTACCGAACCGTCCGAAGGTAGCGCACCA | |
| AM923-hGH-AE144 | MAEPAGSPTSTEEGA SPGTSSTGSPGSSTPS GATGSPGSSTPSGAT GSPGTSTEPSEGSAP GSEPATSGSETPGSP AGSPTSTEEGSTSST AESPGPGTSTPESGS ASPGSTSESPSGTAP GSTSESPSGTAPGTS TPESGSASPGTSTPES GSASPGSEPATSGSE TPGTSESATPESGPG SPAGSPTSEEGTSTE PSEGSAPGTSESATP ESGPGTSTEPSEGSA PGTSTEPSEGSAPGSP AGSPTSTEEGTSTEPS EGSAPGTSESATPES APGTSESATPESGPG | 759 | ATGGCTGAACCTGCTGGCTCTCAACCTCCACTGAGGAAGGTA CCCCGGGTAGCGGTACTGCTTCTTCCTCTCCAGGTAGCTCTACC CCTTCTGGTGCAACCGGCTCTCAGGTGCTTCTCCGGGCACCAG CTCTACCGGTTCTCCAGGTAGCCCGGCTGGCTCTCCTACCTCTA CTGAGGAAGGTACTTCTGAAAGCGCTACTCCTGAGTCTGGTCCA GGTACCTCTACTGAACCGTCCGAAGGTAGCGCTCCAGGAAT CAGCAGGCTCTCCGACTTCCACTGAGGAAGGTACTTCTACTGAA CCTTCCGAAGGCAGCGCACCAGGTACCTCTACTGAACCTTCTGA GGGCAGCGCTCCAGGTACTTCTGAAAGCGCTACCCCGGAATCT GGCCCAGGTAGCGAACCTGCTTCTGGTTCTGAAACCCCAG GTAGCGAACCGGCTACCTCCGGTTCTGAAACTCCAGGTAGCCC GGCAGGCTCTCCGACCTCTACTGAGGAAGGTACTTCTGAAAGC GCAACCCCGGAGTCCGGCCCAGGTACCTCTACCGAACCGTCTG AGGGCAGCGCACCAGGTACCTCTGAAAGCGTCCGAGGGTAG CGCACCAGGTAGCCCAGCAGGTTCTCCTACCTCCACCGAGGAA GGTACTTCTACCGAACCGTCCGAGGGTAGCGCACCAGGTACCT CTACTGAACCTTCTGAGGGCAGCGCTCCAGGTACTTCTGAAAGC GCTACCCCGGAGTCCGGTCCAGGTACTTCTGAAAGCGCGCCGA AGGTAGCGCACCAGGTACTTCTGAAAGCGCAACCCCTGAATCC | 760 |

TABLE 36-continued

Exemplary GHXTEN comprising growth hormones and two XTEN sequences

| GHXTEN Name* | Amino Acid Sequence | SEQ ID NO: | DNA Nucleotide Sequence | SEQ ID NO: |
|---|---|---|---|---|
| | TSESATPESGPGTSTE PSEGSAPGTSTEPSE GSAPGTSESATPESG PGTSTEPSEGSAPGS EPATSGSETPGSPAG SPTSTEEGSSTPSGAT GSPGTPGSGTASSSP GSSTPSGATGSPGTS TEPSEGSAPGTSTEPS EGSAPGSEPATSGSE TPGSPAGSPTSTEEG SPAGSPTSTEEGTSTE PSEGSAPGASASGAP STGGTSESATPESGP GSPAGSPTSTEEGSP AGSPTSTEEGSTSST AESPGPGSTSESPSGT APGTSPSGESSTAPG TPGSGTASSSPGSSTP SGATGSPGSSPSAST GTGPGSEPATSGSET PGTSESATPESGPGS EPATSGSETPGSTSST AESPGPGSTSSTAESP GPGTSPSGESSTAPG SEPATSGSETPGSEP ATSGSETPGTSTEPSE GSAPGSTSSTAESPG PGTSTPESGSASPGST SESPSGTAPGTSTEPS EGSAPGTSTEPSEGS APGTSTEPSEGSAPG SSTPSGATGSPGSSPS ASTGTGPGASPGTSS TGSPGSEPATSGSET PGTSESATPESGPGSP AGSPTSTEEGSSTPS GATGSPGSSPSASTG TGPGASPGTSSTGSP GTSESATPESGPGTS TEPSEGSAPGTSTEPS EGSAPGFPTIPLSRLF DNAMLRAHRLHQL AFDTYQEFEEAYIPK EQKYSFLQNPQTSLC FSESIPTPSNREETQQ KSNLELLRISLLLIQS WLEPVQFLRSVFAN SLVYGASDSNVYDL LKDLEEGIQTLMGRL EDGSPRTGQIFKQTY SKFDTNSHNDDALL KNYGLLYCFRKDMD KVETFLRIVQCRSVE GSCGFGGSEPATSGS ETPGTSESATPESGP GSEPATSGSETPGSP AGSPTSTEEGTSTEPS EGSAPGSEPATSGSE TPGSEPATSGSETPG PSEGSAPGTSESATP ESGPGSEPATSGSET PGTSTEPSEGSAP | | GGTCCAGGTAGCGAACCGGCTACTTCTGGCTCTGAGACTCCAG GTACTTCTACCGAACCGTCCGAAGGTAGCGCACCAGGTACTTCT ACTGAACCGTCTGAAGGTAGCGCACCAGGTACTTCTGAAAGCG CAACCCCGGAATCCGGCCCAGGTACCTCTGAAAGCGCAACCCC GGAGTCCGGCCCAGGTAGCCCTGCTGGCTCTCCAACCTCCACCG AAGAAGGTACCTCTGAAAGCGCAACCCCTGAATCCGGCCCAGG TAGCGAACCGGCAACCTCCGGTTCTGAAACCCCAGGTACCTCT GAAAGCGCTACTCCGGAGTCTGGCCCAGGTACCTCTACTGAAC CGTCTGAGGGTAGCGCTCCAGGTACTTCTACTGAACCGTCCGAA GGTAGCGCACCAGGTACTTCTACCGAACCGTCCGAAGGCAGCG CTCCAGGTACCTCTACTGAACCTTCCGAGGGCAGCGCTCCAGGT ACCTCTACCGAACCTTCTGAAGGTAGCGCACCAGGTACTTCTAC CGAACCGTCCGAGGGTAGCGCACCAGGTAGCCCAGCAGGTTCT CCTACCTCCACCGAGGAAGGTACTTCTACCGAACCGTCCGAGG GTAGCGCACCAGGTACTTCTGAAAGCGCAACTCCTGAGTCTGG CCCAGGTAGCGAACCTGCTACCTCCGGCTCTGAGACTCCAGGT ACCTCTGAAAGCGCAACCCCGGAATCTGGTCCAGGTAGCGAAC CTGCAACCTCTGGCTCTGAAACCCCAGGTACCTCTGAAAGCGCT ACTCCTGAATCTGGCCCAGGTACTTCTACTGAACCGTCCGAGGG CAGCGCACCAGGTACTTCTGAAAGCGCTACTCCTGAGTCCGGC CCAGGTAGCCCGGCTGGCTCTCCGACTTCCACCGAGGAAGGTA GCCCGGCTGGCTCTCCAACTTCTACTGAAGAAGGTAGCCCGGC AGGCTCTCCGACCTCTACTGAGGAAGGTACTTCTGAAAGCGCA ACCCCGGAGTCCGGCCCAGGTACCTCTACCGAACCGTCTGAGG GCAGCGCACCAGGTACCTCTGAAAGCGCAACTCCTGAGTCTGG CCCAGGTAGCGAACCTGCTACCTCCGGCTCTGAGACTCCAGGT ACCTCTGAAAGCGCAACCCCGGAATCTGGTCCAGGTAGCGAAC CTGCAACCTCTGGCTCTGAAACCCCAGGTACCTCTGAAAGCGCT ACTCCTGAATCTGGCCCAGGTACTTCTACTGAACCGTCCGAGGG CAGCGCACCAGGTAGCCCTGCTGGCTCTCCAACCTCCACCGAA GAAGGTACCTCTGAAAGCGCAACCCCTGAATCCGGCCCAGGTA GCGAACCGGCAACCTCCGGTTCTGAAACCCCAGGTACTTCTGA AAGCGCTACTCCTGAGTCCGGCCCAGGTAGCCCGGCTGGCTCTC CGACTTCCACCGAGGAAGGTAGCCCGGCTGGCTCTCCAACTTCT ACTGAAGAAGGTACTTCTACCGAACCTTCCGAGGGCAGCGCAC CAGGTACTTCTGAAAGCGCTACTCCTGAGTCCGGCCCAGGTACT TCTGAAAGCGCTACTCCTGAATCCGGTCCAGGTACTTCTGAAAG CGCTACCCCGGAATCTGGCCCAGGTAGCGAACCGGCTACTTCT GGTTCTGAAACCCCAGGTAGCGAACCGGCTACCTCCGGTTCTG AAACTCCAGGTGCCCAGCAGGTCTCCGACTTCCACTGAGGA GGTTCTGAAACCCCAGGTAGCGAACCGGCTACCTCCGGTTCTG AAACTCCAGGTGCCCAGCAGGTCTCCGACTTCCACTGAGGA AAACTCCAGGTGCCCAGCAGGTCTCCGACTTCCACTGAGGA AGGTACTTCTACTGAACCGTCCGAAGGTAGCGCACCAGGTACTTC TACCGAACCGTCCGAGGGTAGCGCACCAGGTAGCCCAGCAGGT TCTCCTACCTCCACCGAGGAAGGTACTTCTACCGAACCGTCCGA GGGTAGCGCACCAGGTTAA | |
| AM1318-hGH-AE144 | GTSTEPSEGSAPGSE PATSGSETPGSPAGS PTSTEEGSSTSTAESP GPGTSTPESGSASPG STSESPSGTAPGSTSE | 761 | GGTACTTCTACTGAACCGTCTGAAGGCAGCGCACCAGGTAGCG AACCGGCTACTTCCGGTTCTGAAACCCCAGGTAGCCCAGCAGG TTCTCCAACTTCTACTGAAGAAGGTTCTACCAGCTCTACCGCAG AATCTCCTGGTCCAGGTACCTCTACTCCGGAAAGCGGCTCTGCA TCTCCAGGTTCTACTAGCGAATCTCCTTCTGGCACTGCACCAGG | 762 |

TABLE 36-continued

Exemplary GHXTEN comprising growth hormones and two XTEN sequences

| GHXTEN Name* | Amino Acid Sequence | SEQ ID NO: | DNA Nucleotide Sequence | SEQ ID NO: |
|---|---|---|---|---|
| | SPSGTAPGTSTPESGS | | TTCTACTAGCGAATCCCCGTCTGGTACTGCTCCAGGTACTTCTA | |
| | ASPGTSTPESGSASP | | CTCCTGAAAGCGGTTCCGCTTCTCCAGGTACCTCTACTCCGGAA | |
| | GSEPATSGSETPGTS | | AGCGGTTCTGCATCTCCAGGTAGCGAACCGGCAACCTCCGGCT | |
| | ESATPESGPGSPAGS | | CTGAAACCCCAGGTACCTCTGAAAGCGCTACTCCTGAATCCGG | |
| | PTSTEEGTSTEPSEGS | | CCCAGGTAGCCCGGCAGGTTCTCCGACTTCCACTGAGGAAGGT | |
| | APGTSESATPESGPG | | ACCTCTACTGAACCTTCTGAGGGCAGCGCTCCAGGTACTTCTGA | |
| | TSTEPSEGSAPGTSTE | | AAGCGCTACCCCGGAGTCCGGTCCAGGTACTTCTACTGAACCGT | |
| | PSEGSAPGSPAGSPT | | CCGAAGGTAGCGCACCAGGTACTTCTACCGAACCGTCCGAGGG | |
| | STEEGTSTEPSEGSAP | | TAGCGCACCAGGTAGCCCAGCAGGTTCTCCTACCTCCACCGAG | |
| | GTSTEPSEGSAPGTS | | GAAGGTACTTCTACCGAACCGTCCGAGGGTAGCGCACCAGGTA | |
| | ESATPESGPGTSESA | | CTTCTACCGAACCTTCCGAGGCAGCGCACCAGGTACTTCTGAA | |
| | TPESGPGTSTEPSEGS | | AGCGCTACCCCTGAGTCCGGCCCAGGTACTTCTGAAAGCGCTA | |
| | APGTSTEPSEGSAPG | | CTCCTGAATCCGGTCCAGGTACCTCTACTGAACCTTCCGAAGGC | |
| | TSESATPESGPGTSTE | | AGCGCTCCAGGTACCTCTACCGAACCGTCCGAGGGCAGCGCAC | |
| | PSEGSAPGSEPATSG | | CAGGTACTTCTGAAAGCGCAACCCCTGAATCCGGTCCAGGTAC | |
| | SETPGSPAGSPTSTEE | | TTCTACTGAACCTTCCGAAGGTAGCGCTCCAGGTAGCGAACCTG | |
| | GSSTPSGATGSPGTP | | CTACTTCTGGTTCTGAAACCCCAGGTAGCCCGGCTGGCTCTCCG | |
| | GSGTASSSPGSSTPS | | ACCTCCACCGAGGAAGGTAGCTCTACCCCGTCTGGTGCTACTGG | |
| | GATGSPGTSTEPSEG | | TTCTCCAGGTACTCCGGGCAGCGGTACTGCTTCTTCCTCTCCAG | |
| | SAPGTSTEPSEGSAP | | GTAGCTCTACCCCTTCTGGTGCTACTGGCTCTCCAGGTACCTCT | |
| | GSEPATSGSETPGSP | | ACCGAACCGTCCGAGGGTAGCGCACCAGGTACCTCTACTGAAC | |
| | AGSPTSTEEGSPAGS | | CGTCTGAGGGTAGCGCTCCAGGTAGCGAACCGGCAACCTCCGG | |
| | PTSTEEGTSTEPSEGS | | TTCTGAAACTCCAGGTAGCCCTGCTGGCTCTCCGACTTCTACTG | |
| | APGPEPTGPAPSGGS | | AGGAAGGTAGCCCGGCTGGTTCTCCGACTTCTACTGAGGAAGG | |
| | EPATSGSETPGTSES | | TACTTCTACCGAACCTTCCGAAGGTAGCGCTCCAGGTCCAGAAC | |
| | ATPESGPGSPAGSPT | | CAACGGGGCCGGCCCCAAGCGGAGGTAGCGAACCGGCAACCTC | |
| | STEEGTSESATPESGP | | CGGTCTGAAACCCCAGGTACCTCTGAAAGCGCTACTCCTGAAT | |
| | GSPAGSPTSTEEGSP | | CCGGCCCAGGTAGCCCGGCAGGTTCTCCGACTTCCACTGAGGA | |
| | AGSPTSTEEGTSESA | | AGGTACTTCTGAAAGCGCTACTCCTGAGTCCGGCCAGGTAGC | |
| | TPESGPGSPAGSPTST | | CCGGCTGGCTCTCCGACTTCCACCGAGGAAGGTAGCCCGGCTG | |
| | EEGSPAGSPTSTEEG | | GCTCTCCAACTTCTACTGAAGAAGGTACTTCTGAAAGCGCTACT | |
| | STSSTAESPGPGSTSE | | CCTGAGTCCGGCCCAGGTAGCCCGGCTGGCTCTCCGACTTCCAC | |
| | SPSGTAPGTSPSGESS | | CGAGGAAGGTAGCCCGGCTGGCTCTCCAACTTCTACTGAAGAA | |
| | TAPGSTSESPSGTAP | | GGTTCTACCAGCTCTACCGCTGAATCTCCTGGCCCAGGTTCTAC | |
| | GSTSESPSGTAPGTSP | | TAGCGAATCTCCGTCTGGCACCGCACCAGGTACTTCCCCTAGCG | |
| | SGESSTAPGTSTEPSE | | GTGAATCTTCTACTGCACCAGGTTCTACCAGCGAATCTCCTTCT | |
| | GSAPGTSESATPESG | | GGCACCGCTCCAGGTTCTACTAGCGAATCCCCGTCTGGTACCGC | |
| | PGTSESATPESGPGS | | ACCAGGTACTTCTCCTAGCGGCGAATCTTCTACCGCACCAGGTA | |
| | EPATSGSETPGTSES | | CTTCTACCGAACCTTCCGAGGGCAGCGCACCAGGTACTTCTGAA | |
| | ATPESGPGTSESATP | | AGCGCTACCCCTGAGTCCGGCCCAGGTACTTCTGAAAGCGCTA | |
| | ESGPGTSTEPSEGSA | | CTCCTGAATCCGGTCCAGGTAGCGAACCGGCAACCTCTGGCTCT | |
| | PGTSESATPESGPGT | | GAAACCCCAGGTACCTCTGAAAGCGCTACTCCGGAATCTGGTC | |
| | STEPSEGSAPGTSPSG | | CAGGTACTTCTGAAAGCGCTACTCCGGAATCCGGTCCAGGTAC | |
| | ESSTAPGTSPSGESST | | CTCTACTGAACCTTCTGAGGGCAGCGCTCCAGGTACTTCTGAAA | |
| | APGTSPSGESSTAPG | | GCGCTACCCCGGAGTCCGGTCCAGGTACTTCTACTGAACCGTCC | |
| | TSTEPSEGSAPGSPA | | GAAGGTAGCGCACCAGGTACCTCCCTAGCGGCGAATCTTCTA | |
| | GSPTSTEEGTSTEPSE | | CTGCTCCAGGTACCTCTCCTAGCGGCGAATCTTCTACCGCTCCA | |
| | GSAPGSSPSASTGTG | | GGTACCTCCCCTAGCGGTGAATCTTCTACCGCACCAGGTACTTC | |
| | PGSSTPSGATGSPGS | | TACCGAACCGTCCGAGGGTAGCGCACCAGGTAGCCCAGCAGGT | |
| | STPSGATGSPGSSTPS | | TCTCCTACCTCCACCGAGGAAGGTACTTCTACCGAACCGTCCGA | |
| | GATGSPGSSTPSGAT | | GGGTAGCGCACCAGGTTCTAGCCCTTCTGCTTCCACCGGTACCG | |
| | GSPGASPGTSSTGSP | | GCCCAGGTAGCTCTACCCGTCTGGTGCAACTGGCTCTCCAGGT | |
| | GASASGAPSTGGTSP | | AGCTCTACTCCGTCTGGTGCAACCGGCTCCCCAGGTAGCTCTAC | |
| | SGESSTAPGSTSSTA | | CCCGTCTGGTGCTACCGGCTCTCCAGGTAGCTCTACCCCGTCTG | |
| | ESPGPGTSPSGESSTA | | GTGCAACCGGCTCCCCAGGTGCATCCCCGGGTACTAGCTCTACC | |
| | PGTSESATPESGPGT | | GGTTCTCCAGGTGCAAGCGCAAGCGGCGCGCCAAGCACGGGAG | |
| | STEPSEGSAPGTSTEP | | GTACTTCTCCGAGCGGTGAATCTTCTACCGCACCAGGTTCTACT | |
| | SEGSAPGSSPSASTG | | AGCTCTACCGCTGAATCTCCGGGCCCAGGTACTTCTCCGAGCGG | |
| | TGPGSSTPSGATGSP | | TGAATCTTCTACTGCTCCAGGTACCTCTGAAAGCGCTACTCCGG | |
| | GASPGTSSTGSPGTS | | AGTCTGGCCCAGGTACCTCTACTGAACCGTCTGAGGGTAGCGCT | |
| | TPESGSASPGTSPSGE | | CCAGGTACTTCTACTGAACCGTCCGAAGGTAGCGCACCAGGTT | |
| | SSTAPGTSPSGESSTA | | CTAGCCCTTCTGCATCTACTGGTACTGGCCCAGGTAGCTCTACT | |
| | PGTSESATPESGPGS | | CCTTCTGGTGCTACCGGCTCTCCAGGTGCTTCTCCGGGTACTAG | |
| | EPATSGSETPGTSTEP | | CTCTACCGGTTCTCCAGGTACTTCTACTCCGGAAAGCGGTTCCG | |
| | SEGSAPGSTSESPSGT | | CATCTCCAGGTTCTCCTAGCGGTGAATCTTCTACTGCTCCA | |
| | APGSTSESPSGTAPG | | GGTACCTCTCCTAGCGGCGAATCTTCTACTGCTCCAGGTACTTC | |
| | TSTPESGSASPGSPA | | TGAAAGCGCAACCCCTGAATCCGGTCCAGGTAGCGAACCGGCT | |
| | GSPTSTEEGTSESATP | | ACTTCTGGCTCTGAGACTCCAGGTACTTCTACTGAACCGTCCGA | |
| | ESGPGTSTEPSEGSA | | AGGTAGCGCTCCTAGCGGTGAATCCCCTTCTGGTACTG | |
| | PGSPAGSPTSTEEGT | | CTCCAGGTTCTACCAGCGAATCCCCTTCTGGCACCGCACCAGGT | |
| | SESATPESGPGSEPA | | ACTTCTACCCCTGAAAGCGGTTCCGCTTCTCCAGGTAGCCCGGC | |
| | TSGSETPGSSTPSGA | | AGGCTCTCCGACCTCTACTGAGGAAGGTACTTCTGAAAGCGCA | |
| | TGSPGASPGTSSTGS | | ACCCCGGAGTCCGGCCCAGGTACCTCTACCGAACCGTCTGAGG | |
| | PGSSTPSGATGSPGS | | GCAGCGCACCAGGTAGCCCTGCTGGCTCTCCAACCTCCACCGA | |

TABLE 36-continued

Exemplary GHXTEN comprising growth hormones and
two XTEN sequences

| GHXTEN Name* | Amino Acid Sequence | SEQ ID NO: | DNA Nucleotide Sequence | SEQ ID NO: |
|---|---|---|---|---|
| | TSESPSGTAPGTSPSG ESSTAPGSTSSTAESP GPGSSTPSGATGSPG ASPGTSSTGSPGTPG SGTASSSPGSPAGSP TSTEEGSPAGSPTSTE EGTSTEPSEGSAPGF PTIPLSRLFDNAMLR AHRLHQLAFDTYQE FEEAYIPKEQKYSFL QNPQTSLCFSESIPTP SNREETQQKSNLELL RISLLLIQSWLEPVQF LRSVFANSLVYGAS DSNVYDLLKDLEEGI QTLMGRLEDGSPRT GQIFKQTYSKFDTNS HNDDALLKNYGLLY CFRKDMDKVETFLRI VQCRSVEGSCGFGG SEPATSGSETPGTSES ATPESGPGSEPATSG SETPGSPAGSPTSTEE GTSTEPSEGSAPGSE PATSGSETPGSEPAT SGSETPGSEPATSGS ETPGTSTEPSEGSAP GTSESATPESGPGSE PATSGSETPGTSTEPS EGSAP | | AGAAGGTACCTCTGAAAGCGCAACCCCTGAATCCGGCCCAGGT AGCGAACCGGCAACCTCCGGTTCTGAAACCCCAGGTAGCTCTA CCCCGTCTGGTGCTACCGGTTCCCCAGGTGCTTCTCCTGGTACT AGCTCTACCGGTTCTCCAGGTAGCTCTACCCCGTCTGGTGCTAC TGGCTCTCCAGGTTCTACTAGCGAATCCCCGTCTGGTACTGCTC CAGGTACTTCCCCTAGCGGTGAATCTTCTACTGCTCCAGGTTCT ACCAGCTCTACCGCAGAATCTCCGGGTCCAGGTAGCTCTACCCC TTCTGGTGCAACCGGCTCTCCAGGTGCATCCCCGGGTACCAGCT CTACCGGTTCTCCAGGTACTCCGGGTAGCGGTACCGCTTCTTCC TCTCCAGGTAGCCCTGCTGGCTCTCCGACTTCTACTGAGGAAGG TAGCCCGGCTGGTTCTCCGACTTCTACTGAGGAAGGTACTTCTA CCGAACCTTCCGAAGGTAGCGCTCCAGGTTTTCCGACTATTCCG CTGTCTCGTCTGTTTGATAATGCTATGCTGCGTGCGCACCGTCT GCACCAGCTGGCCTTTGATACTTACCAGGAATTTGAAGAAGCcT ACATTCCTAAAGACAGAAGTACTCTTTCCTGCAAAACCCACA GACTTCTCTCTGCTTCAGCGAATCTATTCCGACGCCTTCCAATC GCGAGGAAACTCAGCAAAGTCCAATCTGGAACTACTCCGCAT TTCTCTGCTTCTGATTCAGAGCTGGCTAGAACCAGTGCAATTTC TGCGTTCCGTCTTCGCCAATAGCCTAGTTTATGGCGCATCCGAC AGCAACGTATACGATCTCCTGAAAGATCTCGAGGAAGGCATTC AGACCCTGATGGGTCGTCTCGAGGATGGCTCTCCGCGTACTGGT CAGATCTTCAAGCAGACTTACTCTAAATTTGATACTAACAGCCA CAATGACGATGCCGTTCTAAAAAACTATGGTCTGCTGTATTGTT TTCGTAAAGATATGGACAAAGTTGAAACCTTCCTGCGTATTGTT CAGTGTCGTTCCGTTGAGGGCAGCTGTGGTTTCTAAGGTGGTAG CGAACCGGCAACTTCCGGCTCTGAAACCCCAGGTACTTCTGAA AGCGCTACTCCTGAGTCTGGCCCAGGTAGCGAACCTGCTACCTC TGGCTCTGAAACCCCAGGTAGCCGGCAGGCTCTCCGACTTCCA CCGAGGAAGGTACCTCTACTGAACCTTCTGAGGGTAGCGCTCC AGGTAGCGAACCGGCAACCTCTGGCTCTGAAACCCCAGGTAGC GAACCTGCTACCTCCGGCTCTGAAACTCCAGGTAGCGAACCGG CTACTTCCGGTTCTGAAACTCCAGGTACCTCTACCGAACCTTCC GAAGGCAGCGCACCAGGTACTTCTGAAAGCGCAACCCCTGAAT CCGGTCCAGGTAGCGAACCGGCTACTTCTGGCTCTGAGACTCCA GGTACTTCTACCGAACCGTCCGAAGGTAGCGCACCA | |
| AE48-hGH-AE288 | MAEPAGSPTSTEEGT PGSGTASSSPGSSTPS GATGSPGASPGTSST GSPGFPTIPLSRLFDN AMLRAHRLHQLAFD TYQEFEEAYIPKEQK YSFLQNPQTSLCFSE SIPTPSNREETQQKS NLELLRISLLLIQSWL EPVQFLRSVFANSLV YGASDSNVYDLLKD LEEGIQTLMGRLEDG SPRTGQIFKQTYSKF DTNSHNDDALLKNY GLLYCFRKDMDKVE TFLRIVQCRSVEGSC GFGGTSESATPESGP GSEPATSGSETPGTS ESATPESGPGSEPAT SGSETPGTSESATPES GPGTSTEPSEGSAPG SPAGSPTSTEEGTSES ATPESGPGSEPATSG SETPGTSESATPESGP GSPAGSPTSTEEGSP AGSPTSTEEGTSTEPS EGSAPGTSESATPES GPGTSESATPESGPG TSESATPESGPGSEP ATSGSETPGSEPATS GSETPGSPAGSPTST EEGTSTEPSEGSAPG TSTEPSEGSAPGSEP ATSGSETPGTSESAT PESGPGTSTEPSEGS AP | 763 | ATGGCTGAACCTGCTGGCTCTCCAACCTCCACTGAGGAAGGTA CCCCGGGTAGCGGTACTGCTTCTTCCTCTCCAGGTAGCTCTACC CCTTCTGGTGCAACCGGCTCTCCAGGTGCTTCTCCGGGCACCAG CTCTACCGGTTCTCCAGGTTTTCCGACTATTCCGCTGTCTCGTCT GTTTGATAATGCTATGCTGCGTGCACACCGTCTGCACCAGCTGG CCTTTGATACTTACCAGGAATTTGAAGAAGCcTACATTCCTAAA GAGCAGAAGTACTCTTTCCTGCAAAACCCACAGACTTCTCTCTG CTTCAGCGAATCTATTCCGACGCCTCCAATCGCGAGGAAACTC AGCAAAAGTCCAATCTGGAACTACTCCGCATTTCTCTGCTTCTG ATTCAGAGCTGGCTAGAACCAGTGCAATTTCTGCGTTCCGTCTT CGCCAATAGCCTAGTTTATGGCGCATCCGACAGCAACGTATAC GATCTCCTGAAAGATCTCGAGGAAGGCATTCAGACCCTGATGG GTCGTCTCGAGGATGGCTCTCCGCGTACTGGTCAGATCTTCAAG CAGACTTACTCTAAATTTGATACTAACAGCCACAATGACGATGC CTTCTAAAAAACTATGGTCTGCTGTATTGTTTTCGTAAAGATA TGGACAAAGTTGAAACCTTCCTGCGTATTGTTCAGTGTCGTTCC GTTGAGGGCAGCTGTGGTTTCTAAGGTGGTACCTCTGAAAGCG CAACTCCTGAGTCTGGCCCAGGTAGCGAACCTGCTACCTCCGGC TCTGAGACTCCAGGTACCTCTGAAAGCGCAACCCCGGAATCTG GTCCAGGTAGCGAACCTGCAACCTCTGGCTCTGAAACCCCAGG TACCTCTGAAAGCGCTACTCCTGAATCTGGCCCAGGTACTTCTA CTGAACCGTCCGAGGGCAGCGCACCAGGTAGCCCTGCTGGCTC TCCAACCTCCACCGAAGAAGGTACCTCTGAAAGCGCAACCCCT GAATCCGGCCCAGGTAGCGAACCGGCAACCTCCGGTTCTGAAA CCCCAGGTACTTCTGAAAGCGCTACTCCTGAGTCCGGCCCAGGT AGCCCGGCTGGCTCTCCGACTTCCACCGAGGAAGGTAGCCCGG CTGGCTCTCCAACTTCTACTGAAGAAGGTACTTCTACCGAACCT TCCGAGGGCAGCGCACCAGGTACTTCTGAAAGCGCTACCCCTG AGTCCGGCCCAGGTACTTCTGAAAGCGCTACTCCTGAATCCGGT CCAGGTACTTCTGAAAGCGCTACTCCCGGAATCTGGCCCAGGTA GCGAACCGGCTACTTCTGGTTCTGAAACCCAGGTAGCGAACC GGCTACCTCCGGTTCTGAAACTCCAGGTAGCCCAGCAGGCTCTC CGACTTCCACTGAGGAAGGTACTTCTACCGAACCTTCCGAAGGC AGCGCACCAGGTACTTCTACTGAACCTTCTGAGGGCAGCGCTC CAGGTAGCGAACCTGCAACCTCTGGCTCTGAAACCCCAGGTAC CTCTGAAAGCGCTACTCCTGAATCTGGCCCAGGTACTTCTACTG AACCGTCCGAGGGCAGCGCACCA | 764 |

TABLE 36-continued

Exemplary GHXTEN comprising growth hormones and
two XTEN sequences

| GHXTEN Name* | Amino Acid Sequence | SEQ ID NO: | DNA Nucleotide Sequence | SEQ ID NO: |
|---|---|---|---|---|
| AM48-hGH-AE288 | MAEPAGSPTSTEEGA SPGTSSTGSPGSSTPS GATGSPGSSTPSGAT GSPGFPTIPLSRLFDN AMLRAHRLHQLAFD TYQEFEEAYIPKEQK YSFLQNPQTSLCFSE SIPTPSNREETQQKS NLELLRISLLLIQSWL EPVQFLRSVFANSLV YGASDSNVYDLLKD LEEGIQTLMGRLEDG SPRTGQIFKQTYSKF DTNSHNDDALLKNY GLLYCFRKDMDKVE TFLRIVQCRSVEGSC GFGGTSESATPESGP GSEPATSGSETPGTS ESATPESGPGSEPAT SGSETPGTSESATPES GPGTSTEPSEGSAPG SPAGSPTSEEGTSES ATPESGPGSEPATSG SETPGTSESATPESGP GSPAGSPTSEEGSP AGSPTSEEGTSTEPS EGSAPGTSESATPES GPGTSESATPESGPG TSESATPESGPGSEP ATSGSETPGSEPATS GSETPGSPAGSPTST EEGTSTEPSEGSAPG TSTEPSEGSAPGSEP ATSGSETPGTSESAT PESGPGTSTEPSEGS AP | 765 | ATGGCTGAACCTGCTGGCTCTCCAACCTCCACTGAGGAAGGTG CATCCCCGGGCACCAGCTCTACCGGTTCTCCAGGTAGCTCTACC CCGTCTGGTGCTACCGGCTCTCCAGGTAGCTCTACCCCGTCTGG TGCTACTGGCTCTCCAGGTTTTCCGACTATTCCGCTGTCTCGTCT GTTTGATAATGCTATGCTGCGTGCGCACCGTCTGCACCAGCTGG CCTTTGATACTTACCAGGAATTTGAAGAAGcTACATTCCTAAA GAGCAGAAGTACTCTTTCCTGCAAAACCCACAGACTTCTCTCTG CTTCAGCGAATCTATTCCGACGCCTTCCAATCGCGAGGAAACTC AGCAAAAGTCCAATCTGGAACTACTCCGCATTTCTCTGCTTCTG ATTCAGAGCTGGCTAGAACCAGTGCAATTTCTGCGTTCCGTCTT CGCCAATAGCCTAGTTTATGCGCATCCGACAGCAACGTATAC GATCCTGAAAGATCTCGAGGAAGGCATTCAGACCCTGATGG GTCGTCTCGAGGATGGCTCTCCGCGTACTGGTCAGATCTTCAAG CAGACTTACTCTAAATTTGATACTAACAGCCACAATGACGATGC GCTTCTAAAAAACTATGGTCTGCTGTATTGTTTTCGTAAAGATA TGGACAAAGTTGAAACCTTCCTGCGTATTGTTCAGTGTCGTTCC GTTGAGGGCAGCTGTGGTTTCTAAGGTGGTACCTCTGAAAGCG CAACTCCTGAGTCTGGCCCAGGTAGCGAACCTGCTACCTCCGGC TCTGAGACTCCAGGTACCTCTGAAAGCGCAACCCCGGAATCTG GTCCAGGTAGCGAACCTGCAACCTCTGGCTCTGAAACCCCAGG TACCTCTGAAAGCGCTACTCCTGAATCTGGCCCAGGTACTTCTA CTGAACCGTCCGAGGGCAGCGCACCAGGTAGCCCTGCTGGCTC TCCAACCTCCACCGAAGAAGGTACTTCTGAAAGCGCAACCT GAATCCGGCCCAGGTAGCGAACCGGCAACCTCCGGTTCTGAAA CCCCAGGTACTTCTGAAAGCGCTACTCCTGAGTCCGGCCCAGGT AGCCCGGCTGGCTCTCCGACTTCCACCGAGGAAGGTAGCCCGG CTGGCTCTCCAACTTCTACTGAAGAAGGTACTTCTACCGAACCT TCCGAGGGCAGCGCACCAGGTACTTCTGAAAGCGCTACCCCTG AGTCCGGCCCAGGTACTTCTGAAAGCGCTACTCCTGAATCCGGT CCAGGTACTTCTGAAAGCGCTACCCGGAATCTGGCCCAGGTA GCGAACCGGCTACTTCTGGTTCTGAAACCCCAGGTAGCGAACC GGCTACTTCCGGTTCTGAAACTCCAGGTACCTCTGAAAGCGGT AGCGCACCTGGCTCTGCCCTGAAAGCGCTACTCCTGAATCCGGT CCAGGTACTTCTGAAACCCCAGGTAGCGAACCTGCAACCTCTGGCTCTGAAACCCCAGGTAC CTCTGAAAGCGCTACTCCTGAATCTGGCCCAGGTACTTCTACTG AACCGTCCGAGGGCAGCGCACCA | 766 |
| AE144-hGH-AE288 | GSEPATSGSETPGTS ESATPESGPGSEPAT SGSETPGSPAGSPTST EEGTSTEPSEGSAPG SEPATSGSETPGSEP ATSGSETPGSEPATS GSETPGTSTEPSEGS APGTSESATPESGPG SEPATSGSETPGTSE PSEGSAPGFPTIPLSR LFDNAMLRAHRLHQ LAFDTYQEFEEAYIP KEQKYSFLQNPQTSL CFSESIPTPSNREETQ QKSNLELLRISLLLIQ SWLEPVQFLRSVFA NSLVYGASDSNVYD LLKDLEEGIQTLMGR LEDGSPRTGQIFKQT YSKFDTNSHNDDAL LKNYGLLYCFRKDM DKVETFLRIVQCRSV EGSCGFGGTSESATP ESGPGSEPATSGSET PGTSESATPESGPGS EPATSGSETPGTSES ATPESGPGTSTEPSE GSAPGSPAGSPTSTE EGTSESATPESGPGS EPATSGSETPGTSES ATPESGPGSPAGSPT STEEGSPAGSPTSTEE GTSTEPSEGSAPGTS ESATPESGPGTSESA TPESGPGTSESATPES GPGSEPATSGSETPG | 767 | GGTAGCGAACCGGCAACTTCCGGCTCTGAAACCCCAGGTACTT CTGAAAGCGCTACTCCTGAGTCTGGCCCAGGTAGCGAACCTGC TACCTCTGGCTCTGAAACCCCAGGTAGCCCGGCAGGCTCTCCGA CTTCCACCGAGGAAGGTACCTCTACTGAACCTTCTGAGGGTAGC GCTCCAGGTAGCGAACCGGCAACCTCTGGCTCTGAAACCCCAG GTAGCGAACCGGCTACCTCCGGCTCTGAAACTCCAGGTAGCGA ACCGGCTACTTCCGGTTCTGAAACTCCAGGTACCTCTACCGAAC CTTCCGAAGGCAGCGCACCAGGTACTTCTGAAAGCGCAACCCC TGAATCCGGTCCAGGTAGCGAACCGGCTACTTCTGGCTCTGAG ACTCCAGGTACTTCTACCGAACCGTCCGAAGGTAGCGCACCAG GTTTTCCGACTATTCCGCTGTCTCGTCTGTTTGATAATGCTATGC TGCGTGCGCACCGTCTGCACCAGCTGGCCTTTGATACTTACCAG GAATTTGAAGAAGcTACATTCCTAAAGAGCAGAAGTACTCTTT CCTGCAAAACCCTCTTCTGCTTCAGCGAATCTATTC CGACGCCTTCCAATCGCGAGGAAACTCAGCAAAAGTCCAATCT GGAACTACTCCGCATTTCTCTGCTTCTGATTCAGAGCTGGCTAG AACCAGTGCAATTTCTGCGTTCCGTCTTCGCCAATAGCCTAGTT TATGGCGCATCCGACAGCAACGTATACGATCTCCTGAAAGATC TCGAGGAAGGCATTCAGACCCTGATGGGTCGTCTCGAGGATGG CTCTCCGCGTACTGGTCAGATCTTCAAGCAGACTTACTCTAAAT TTGATACTAACAGCCACAATGACGATGCGCTTCTAAAAAACTA TGGTCTGCTGTATTGTTTTCGTAAAGATATGGACAAAGTTGAAA CCTTCCTGCGTATTGTTCAGTGTCGTTCCGTTGAGGGCTGT GGTTTCTAAGGTGGTACCTCTGAAAGCGCAACTCCTGAGTCTGG CCCAGGTAGCGAACCTGCTACCTCCGGCTCTGAGACTCCAGGT ACCTCTGAAAGCGCAACCCCGGAATCTGGTCCAGGTAGCGAAC CTGCAACCTCTGGCTCTGAAACCCCAGGTACCTCTGAAAGCGCT ACTCCTGAATCTGGCCCAGGTACTTCTACTGAACCGTCCGAGGG CAGCGCACCAGGTAGCCCTGCTGGCTCTCCAACCTCCACCGAA GAAGGTACCTCTGAAAGCGCAACCCCTGAATCCGGCCCAGGTA GCGAACCGGCAACTTCCGGCTCTGAAACCCCAGGTACTTCTGA AAGCGCTACTCCTGAGTCCGGCCCAGGTAGCCCGGCTGGCTCTC CGACTTCCACCGAGGAAGGTAGCCCGGCTGGCTCTCCAACTTCT ACTGAAGAAGGTACTTCTACCGAACCTTCCGAGGGCAGCGCAC AGGTACTTCTGAAAGCGCTACCCCTGAGTCCGGCCCAGGTACT TCTGAAAGCGCTACTCCTGAATCCGGTCCAGGTACTTCTGAAAG | 768 |

TABLE 36-continued

Exemplary GHXTEN comprising growth hormones and two XTEN sequences

| GHXTEN Name* | Amino Acid Sequence | SEQ ID NO: | DNA Nucleotide Sequence | SEQ ID NO: |
|---|---|---|---|---|
| | SEPATSGSETPGSPA GSPTSTEEGTSTEPSE GSAPGTSTEPSEGSA PGSEPATSGSETPGT SESATPESGPGTSTEP SEGSAP | | CGCTACCCCGGAATCTGGCCCAGGTAGCGAACCGGCTACTTCT GGTTCTGAAACCCCAGGTAGCGAACCGGCTACCTCCGGTTCTG AAACTCCAGGTAGCCCAGCAGGCTCTCCGACTTCCACTGAGGA AGGTACTTCTACTGAACCTTCCGAAGGCAGCGCACCAGGTACC TCTACTGAACCTTCTGAGGGCAGCGCTCCAGGTAGCGAACCTG CAACCTCTGGCTCTGAAACCCCAGGTACCTCTGAAAGCGCTACT CCTGAATCTGGCCCAGGTACTTCTACTGAACCGTCCGAGGGCA GCGCACCA | |
| AE288-hGH-AE288 | GTSESATPESGPGSE PATSGSETPGTSESA TPESGPGSEPATSGS ETPGTSESATPESGP GTSTEPSEGSAPGSP AGSPTSTEEGTSESA TPESGPGSEPATSGS ETPGTSESATPESGP GSPAGSPTSTEEGSP AGSPTSTEEGTSTEPS EGSAPGTSESATPES GPGTSESATPESGPG TSESATPESGPGSEP ATSGSETPGSEPATS GSETPGSPAGSPTST EEGTSTEPSEGSAPG TSTEPSEGSAPGSEP ATSGSETPGTSESAT PESGPGTSTEPSEGS APGFPTIPLSRLFDNA MLRAHRLHQLAFDT YQEFEEAYIPKEQKY SFLQNPQTSLCFSESI PTPSNREETQQKSNL ELLRISLLLIQSWLEP VQFLRSVFANSLVY GASDSNVYDLLKDL EEGIQTLMGRLEDGS PRTGQIFKQTYSKFD TNSHNDDALLKNYG LLYCFRKDMDKVET FLRIVQCRSVEGSCG FGGTSESATPESGPG SEPATSGSETPGTSES ATPESGPGSEPATSG SETPGTSESATPESGP GTSTEPSEGSAPGSP AGSPTSTEEGTSESA TPESGPGSEPATSGS ETPGTSESATPESGP GSPAGSPTSTEEGSP AGSPTSTEEGTSTEPS EGSAPGTSESATPES GPGTSESATPESGPG TSESATPESGPGSEP ATSGSETPGSEPATS GSETPGSPAGSPTST EEGTSTEPSEGSAPG TSTEPSEGSAPGSEP ATSGSETPGTSESAT PESGPGTSTEPSEGS AP | 769 | GGTACCTCTGAAAGCGCAACTCCTGAGTCTGGCCCAGGTAGCG AACCTGCTACCTCCGGTCTGAGGACTCCAGGTACCTCTGAAAGC GCAACCCCGGAATCTGGTCCAGGTAGCGAACCTGCAACCTCTG GCTCTGAAACCCCAGGTACCTCTGAAAGCGCTACTCCTGAATCT GGCCCAGGTACTTCTACTGAACCGTCCGAGGGCAGCGCACCAG GTAGCCCTGCTCTCCAACCTCCACCGAAGAAGGTACCTCT GAAAGCGCAACCCCTGAATCCGGCCCAGGTAGCGAACCGGCAA CCTCCGGTTCTGAAACCCCAGGTACCTCTGAAAGCGCTACTCCT GAGTCCGGCCCAGGTAGCCCGGCTGGCTCTCCGACTTCCACCG AGGAAGGTAGCCCGGCTCCAACCTCTACTGAAGAAGG TACTTCTACCGAACCTTCCGAGGGCAGCGCACCAGGTACTTCTG AAAGCGCTACCCCTGAGTCCGGCCCAGGTACTTCTGAAAGCGC TACTCCTGAATCCGGTCCAGGTACTTCTGAAAGCGCTACCCCGG AATCTGGCCCAGGTAGCGAACCGGCTACCTCCGGTTCTGAAACC CCAGGTAGCGAACCGGCTACCTCCGGTTCTGAAACTCCAGGTA GCCCAGCAGGCTCTCCGACTTCCACTGAGGAAGGTACTTCTACT GAACCTTCCGAAGGCAGCGCACCAGGTACCTCTACTGAACCTT CTGAGGGCAGCGCTCCAGGTAGCGAACCTGCAACCTCTGGCT CTGAAACCCCAGGTACCTCTGAAAGCGCTACTCCTGAATCGGCC CAGGTACTTCTACTGAACCGTCCGAGGGCAGCGCACCAGGTTTT CCGACTATTCCGCTGTCTCGTCTGTTTGATAATGCTATGCTGCGT GCGCACCGTCTGCACCAGCTGGCCTTTGATACTTACCAGGAATT TGAAGAAGCCTACATTCCTAAAGAGCAGAAGTACTCTTTCCTGC AAAACCCACAGACTTCTCTCTGCTTCAGCGAATCTATTCCGACG CCTTCCAATCGCGAGGAAACTCAGCAAAAGTCCAATCTGGAAC TACTCCGCATTTCTCTGCTTCTGATTCAGAGCTGGCTAGAACCA GTGCAATTTCTGCGTTCCGTCTTCGCCAATAGCCTAGTTTATGG CGCATCCGACAGCAACGTATACGATCTCCTGAAAGATCTCGAG GAAGGCATTCAGACCCTGATGGGTCGTCTCGAGGATGGCTCTC CGCGTACTGGTCAGATCTTCAAGCAGACTTACTCTAAATTTGAT ACTAACAGCCACAATGACGATGCGCTTCTAAAAAACTATGGT CTGCTATATTGTTTTCGTAAAGATATGGACAAAGTTGAAACCTTC CTGCGTATTGTTCAGTGTCGTTCCGTTGAGGGCAGCTGTGGTTT CTAAGGTGGTACCTCTGAAAGCGCAACTCCTGAGTCTGGCCCA GGTAGCGAACCTGCTACCTCCGGTCTGAGGACTCCAGGTACCTC TGAAAGCGCAACCCCGGAATCTGGTCCAGGTAGCGAACCTGCA ACCTCTGGCTCTGAAACCCCAGGTACCTCTGAAAGCGCTACTCC TGAATCTGGCCCAGGTACTTCTACTGAACCGTCCGAGGGCAGC GCACCAGGTAGCCCTGCTGGCTCTCCAACCTCCACCGAAGAAG GTACCTCTGAAAGCGCAACCCCTGAATCCGGCCCAGGTAGCGA ACCGGCAACCTCCGGTTCTGAAACCCCAGGTACTTCTGAAAGC GCTACTCCTGAGTCCGGCCCAGGTAGCCCGGCTGGCTCTCCGAC TTCCACCGAGGAAGGTAGCCCGGCTCCAACTTCTACTG AAGAAGGTACTTCTACCGAACCTTCCGAGGGCAGCGCACCAGG TACTTCTGAAAGCGCTACCCCTGAGTCCGGCCCAGGTACTTCTG AAAGCGCTACTCCTGAATCCGGTCCAGGTACTTCTGAAAGCGCT ACCCCGGAATCTGGCCCAGGTAGCGAACCGGCTACTTCGGTTC TGAAACCCCAGGTAGCGAACCGGCTACCTCCGGTTCTGAAACT CCAGGTAGCCCAGCAGGCTCTCCGACTTCCACTGAGGAAGGTA CTTCTACTGAACCTTCCGAAGGCAGCGCACCAGGTACCTCTACT GAACCTTCTGAGGGCAGCGCTCCAGGTAGCGAACCTGCAACCT CTGGCTCTGAAACCCCAGGTACCTCTGAAAGCGCTACTCCTGAA TCTGGCCCAGGTACTTCTACTGAACCGTCCGAGGGCAGCGCAC CA | 770 |
| AF144-hGH-AE288 | GTSTPESGSASPGTSP SGESSTAPGTSPSGES STAPGSTSSTAESPGP GSTSESPSGTAPGSTS STAESPGPGTSPSGES STAPGTSTPESGSASP GSTSSTAESPGPGTSP SGESSTAPGTSPSGES STAPGTSPSGESSTAP GFPTIPLSRLFDNAM | 771 | GGTACTTCTACTCCGGAAAGCGGTTCCGCATCTCCAGGTACTTC TCCTAGCGGTGAATCTTCTACTGCTCCAGGTACCTCTCCTAGCG GCGAATCTTCTACTGCTCCAGGTTCTACCAGCTCTACCGCTGAA TCTCCTGGCCCAGGTTCTACCAGCGAATCCCCGTCTGGCACCGC ACCAGGTTCTACTAGCTCCACAGAATCTCCGGGTCCAGGTA CTTCCCCTAGCGGTGAATCTTCTACTGCTCCAGGTACCTCTACT CCGGAAAGCGGCTCCGCATCTCCAGGTTCTACTAGCTCTACTGC TGAATCTCCTGGTCCAGGTACCTCCCCTAGCGGCGAATCTTCTA CTGCTCCAGGTACCTCTCCTAGCGGCGAATCTTCTACCGCTCCA GGTACTCCCCTAGCGGTGAATCTTCTACCGCACCAGGTTTTCC | 772 |

TABLE 36-continued

Exemplary GHXTEN comprising growth hormones and two XTEN sequences

| GHXTEN Name* | Amino Acid Sequence | SEQ ID NO: | DNA Nucleotide Sequence | SEQ ID NO: |
|---|---|---|---|---|
| | LRAHRLHQLAFDTY QEFEEAYIPKEQKYS FLQNPQTSLCFSESIP TPSNREETQQKSNLE LLRISLLLIQSWLEPV QFLRSVFANSLVYG ASDSNVYDLLKDLE EGIQTLMGRLEDGSP RTGQIFKQTYSKFDT NSHNDDALLKNYGL LYCFRKDMDKVETF LRIVQCRSVEGSCGF GGTSESATPESGPGS EPATSGSETPGTSES ATPESGPGSEPATSG SETPGTSESATPESGP GTSTEPSEGSAPGSP AGSPTSTEEGTSESA TPESGPGSEPATSGS ETPGTSESATPESGP GSPAGSPTSEEGSP AGSPTSTEEGTSTEPS EGSAPGTSESATPES GPGTSESATPESGPG TSESATPESGPGSEP ATSGSETPGSEPATS GSETPGSPAGSPTST EEGTSTEPSEGSAPG TSTEPSEGSAPGSEP ATSGSETPGTSESAT PESGPGTSTEPSEGS AP | | GACTATTCCGCTGTCTCGTCTGTTTGATAATGCTATGCTGCGTG CGCACCGTCTGCACCAGCTGGCCTTTGATACTTACCAGGAATTT GAAGAAGCcTACATTCCTAAAGAGCAGAAGTACTCTTTCCTGCA AAACCCACAGACTTCTCTCTGCTTCAGCGAATCTATTCCGACGC CTTCCAATCGCGAGGAAACTCAGCAAAAGTCCAATCTGGAACT ACTCCGCATTTCTCTGCTTCTGATTCAGAGCTGGCTAGAACCAG TGCAATTTCTGCGTTCCGTCTTCGCCAATAGCCTAGTTTATGGC GCATCCGACAGCAACGTATACGATCTCCTGAAAGATCTCGAGG AAGGCATTCAGACCCTGATGGGCGTCTCGAGGATGGCTCTCC GCGTACTGGTCAGATCTTCAAGCAGACTTACTCTAAATTTGATA CTAACAGCCACAATGACGATGCGCTTCTAAAAAACTATGGTCT GCTGTATTGTTTTCGTAAAGATATGGACAAAGTTGAAACCTTCC TGCGTATTGTTCAGTGTCGTTCCGTTGAGGGCAGCTGTGGTTTC TAAGGTGGTACCTCTGAAAGCGCAACTCCTGAGTCTGGCCCAG GTAGCGAACCTGCTACCTCCGGCTCAGGACTCCAGGTACCTCT GAAAGCGCAACCCCGGAATCTGGTCCAGGTAGCGAACCTGCAA CCTCTGGCTCTGAAACCCCAGGTACCTCTGAAAGCGCTACTCCT GAATCTGGCCCAGGTACTTCTACTGAACCGTCCGAGGGCAGCG CACCAGGTAGCCCTGGCTCTCCAACCTCCACCGAAGAAGG TACCTCTGAAAGCGCAACCCCTGAATCGGCCCAGGTAGCGAA CCGGCAACCTCCGGTTCTGAAACCCCAGGTACTTCTGAAAGCG CTACTCCTGAGTCCGGCCCAGGTAGCCCGGCTGGCTCTCCGACT TCCACCGAGGAAGGTAGCCCGGCTGGCTCTCCAACTTCTACTGA AGAAGGTACTTCTACCGAACCTTCCGAGGGCAGCGCACCAGGT ACTTCTGAAAGCGCTACCCCTGAGTCCGGCCCAGGTACTTCTGA AAGCGCTACTCCTGAATCCGGTCCAGGTACTTCTGAAAGCGCTA CCCCGGAATCTGGCCCAGGTAGCGAACCGGCTACTTCTGGTTCT GAAACCCCAGGTAGCGAACCGGCTACCTCCGGTTCTGAAACTC CAGGTAGCCCAGCAGGCTCTCCGACTTCCACTGAGGAAGGTAC TTCTACTGAACCTTCCGAAGGCAGCGCACCAGGTACCTCTACTG AACTTCTGAGGGCAGCGCTCCAGGTAGCGAACCTGCAACCTC TGGCTCTGAAACCCCAGGTACCTCTGAAAGCGCTACTCCTGAAT CTGGCCCAGGTACTTCTACTGAACCGTCCGAGGGCAGCGCACCA | |
| AD576-hGH-AE288 | GSSESGSSEGGPGSG GEPSESGSSGSSESGS SEGGPGSSSESGSSEG GPGSSSESGSSEGGPG SSESGSSEGGPGSSES GSSEGGPGESPGGSS GSESGSSEGSSGPGES SGSSSESGSSEGGPGS SESGSSEGGPGSSSES GSSEGGPGSGGEPSE SGSSGESPGGSSGSE SGESPGGSSGSESGS GGEPSESGSSGSSSES GSSEGGPGSGGEPSE SGSSGGGEPSESGS SGSEGSSGPGESSGE SPGGSSGSESGSGGE PSESGSSGGGEPSESS GSSESGSSEGGPGES PGGSSGSESGESPGG SSGSESGESPGGSSG SESGPGGSSGSESGSS SESGSESPGGSSGES GESPGGSSGSESGSS ESGSSEGGPGSGGEP SESGSSGSEGSSGPG ESSGSSSESGSSEGGP GSGGEPSESGSSGSS ESGSSGESPGGSSG SESGESPGGSSGSES GSSESGSSEGGPGSG GEPSESGSSGSSESGS SEGGPGSGGEPSESG SSGGEPSESGSSSS ESPGGSSGSESGSEG SSGPGESSGSSESGSS EGGPGSEGSSGPGES SGFPTIPLSRLFDNA MLRAHRLHQLAFDT | 773 | GGTTCCTCTGAAAGCGGTTCTTCCGAAGGTGGTCCAGGTTCCTC TGAAAGCGGTTCTTCTGAGGGTGGTCCAGGTGAATCTCCGAGT GGCTCCAGCGGTTCCGAGTCAGGTTCTGGTGGCGAACCTTCCGA GTCTGGTAGCTCAGGTGAATCTCCGGGTGGTTCTAGCGGTTCCG AGTCAGGTGAATCTCCGGGTGGTTCCAGCGGTTCTGAGTCAGGT TCCTCCGAAAGCGGTTCTTCTGAGGGCGGTTCCAGGTTCCTCCGA AAGCGGTTCTTCCGAGGGCGGTCCAGGTTCTTCTGAAAGCGGTT CTTCCGAGGGCGGTCCAGGTGAATCTCCGGTGGTTCCAGCGGT TCCGAGTCAGGTGAATCTCCAGGTGGCTCTAGCGGTTCCGAGTC AGGTGAATCTCCTGGTGGTTCTAGCGGTTCTGAATCAGGTTCCT CCGAAAGCGGTTCTTCTGAGGGCGGTCCAGGTTCCTCCGAAAG CGGTTCTTCCGAGGGCGGTCCAGGTTCTTCTGAAAGCGGTTCTT CCGAGGGCGGTCCAGGTTCCTCTGAAAGCGGTTCTTCTGAGGG CGGTTCCAGGTTCTTCCGAAAGCGGTTCTTCGAAGGCGGTCCAG GTTCTTCCGAAAGCGGTTCTTCGAAGGCGGTCCAGGTTCTGGT GGCGAACCGTCCGAGTCTGGTAGCTCAGGTGAATCTCCGGGTG GCTCTAGCGGTTCCGAGTCAGGTGAATCTCCTGGTGGTTCCAGC GGTTCCGAGTCAGGTTCCGGTGGCGAACCGTCCGAATCTGGTA GCTCAGGTAGCGAAGGTTCTTCTGGTCCAGGCGAATCTTCAGGT TCCTCTGAAAGCGGTTCTTCTGAGGGCGGTCCAGGTTCCGGTGG CGAACCGTCCGAATCTGGTAGCTCAGGTAGCGAAGGTTCTTCTG GTCCAGGCGAATCTTCAGGTTCCTCTGAAAGCGGTTCTTCTGAG GGCGGTCCAGGTTCCGAACCTTCCGAATCTGGTAGCTC AGGTGAATCTCCGGGTGGTTCTAGCGGTTCTGAGTCAGGTTCTG GTGGTGAACCTTCCGAGTCTGGTAGCTCAGGTTCTGGTGGCGAA CCATCCGAGTCTGGTAGCTCAGGTTCTTCCGAAAGCGGTTCTTC CGAAGGCGGTCCAGGTTCTGGTGGTGAACCGTCCGAATCTGGT AGCTCAGGTTCTGGTGGCGAACCATCCGAATCTGGTAGCTCAG GTAGCGAAGGTTCTTCTGGTCCTGGCGAATCTTCAGGTGAATCT CCAGGTGGCTCTAGCGGTTCCGAATCAGGTAGCGAAGGTTCTTC CGGTCCAGGTGAATCTTCTGGTTCCTG GTGAATCCTCAGGTTCCGGTGGCGAACCATCCGAATCTGGTAGC TCAGGTTCCTCTGAAAGCGGTTCTTCCGAAGGTGGTCCAGGTTC CTCTGAAAGCGGTTCTTCTGAGGGTGGTCCAGGTGAATCTCCGG GTGGCTCCAGCGGTTCCGAGTCAGGTTCTGGTGGCGAACCTTC GAATCTGGTAGCTCAGGTAGCGAAGGTTCTTCTGGTCCTGGCGA ATCTTCAGGTGAATCTCCAGGTGGCTCTAGCGGTTCCGAGTCAG GTAGCGAAGGTTCTTC TGGTCCTGGCGAGTCCTCAGGTTTTCCGACTATTCCGCTGTCTC | 774 |

TABLE 36-continued

Exemplary GHXTEN comprising growth hormones and two XTEN sequences

| GHXTEN Name* | Amino Acid Sequence | SEQ ID NO: | DNA Nucleotide Sequence | SEQ ID NO: |
|---|---|---|---|---|
| | YQEFEEAYIPKEQKY SFLQNPQTSLCFSESI PTPSNREETQQKSNL ELLRISLLLIQSWLEP VQFLRSVFANSLVY GASDSNVYDLLKDL EEGIQTLMGRLEDGS PRTGQIFKQTYSKFD TNSHNDDALLKNYG LLYCFRKDMDKVET FLRIVQCRSVEGSCG FGGTSESATPESGPG SEPATSGSETPGTSES ATPESGPGSEPATSG SETPGTSESATPESGP GTSTEPSEGSAPGSP AGSPTSTEEGTSESA TPESGPGSEPATSGS ETPGTSESATPESGP GSPAGSPTSTEEGSP AGSPTSTEEGTSTEPS EGSAPGTSESATPES GPGTSESATPESGPG TSESATPESGPGSEP ATSGSETPGSEPATS GSETPGSPAGSPTST EEGTSTEPSEGSAPG TSTEPSEGSAPGSEP ATSGSETPGTSESAT PESGPGTSTEPSEGS AP | | GTCTGTTTGATAATGCTATGCTGCGTGCGCACCGTCTGCACCAG CTGGCCTTTGATACTTACCAGGAATTTGAAGAAGCcTACATTCC TAAAGAGCAGAAGTACTCTTTCCTGCAAAACCCACAGACTTCTC TCTGCTTCAGCGAATCTATTCCGACGCCTTCCAATCGCGAGGAA ACTCAGCAAAAGTCCAATCTGGAACTACTCCGCATTTCTCTGCT TCTGATTCAGAGCTGGCTAGAACCAGTGCAATTTCTGCGTTCCG TCTTCGCCAATAGCCTAGTTTATGGCGCATCCGACAGCAACGTA TACGATCTCCTGAAAGATCTCGAGGAAGGCATTCAGACCCTGA TGGGTCGTCTCGAGGATGGCTCTCCGCGTACTGGTCAGATCTTC AAGCAGACTTACTCTAAATTTGATACTAACAGCCACAATGACG ATGCGCTTCTAAAAAACTATGGTCTGCTGTATTGTTTTCGTAAA GATATGGACAAAGTTGAAACCTTCCTGCGTATTGTTCAGTGTCG TTCCGTTGAGGGCAGCTGTGGTTTCTAAGGTGGTACCTCTGAAA GCGCAACTCCTGAGTCTGGCCCAGGTAGCGAACCTGCTACCTCC GGCTCTGAGACTCCAGGTACCTCTGAAAGCGCAACCCCGGAAT CTGGTCCAGGTAGCGAACCTGCAACCTCTGGCTCTGAAACCCC AGGTACCTCTGAAAGCGCTACTCCTGAATCTGGCCCAGGTACTT CTACTGAACCGTCCGAGGGCAGCGCACCAGGTAGCCCTGCTGG CTCTCCAACCTCCACCGAAGAGCGCAAC CCTGAATCCGGCCCAGGTAGCGAACCGGCAACCTCCGGTTCTG AAACCCCAGGTACTTCTGAAAGCGCTACTCCTGAGTCCGGCCC AGGTAGCCCGGCTGGCTCTCCGACTTCCACCGAGGAAGGTAGC CCGGCTGGCTCTCCAACTTCTACTGAAGAAGGTACTTCTACCGA ACCTTCCGAGGGCAGCGCACCAGGTACTTCTGAAAGCGCTACC CCTGAGTCCGGCCCAGGTACTTCTGAAAGCGCTACTCCTGAATC CGGTCCAGGTACTTCTGAAAGCGCTACCCCGGAATCTGGCCCA GGTAGCGAACCGGCTACTTCTGGTTCTGAAACCCCAGGTAGCG AACCGGCTACCTCCGGTTCTGAAACTCCAGGTAGCCCAGCAGG CTCTCCGACTTCCACTGAGGAAGGTACTTCTACTGAACCTTCCG AAGGCAGCGCACCAGGTACCTCTACTGAACCTTCTGAGGGCAG CGCTCCAGGTAGCGAACCTGCAACCTCTGGCTCTGAAACCCCA GGTACCTCTGAAAGCGCTACTCCTGAATCTGGCCCAGGTACTTC TACTGAACCGTCCGAGGGCAGCGCACCA | |
| AE576-hGH-AE288 | GSPAGSPTSTEEGTS ESATPESGPGTSTEPS EGSAPGSPAGSPTST EEGTSTEPSEGSAPG TSTEPSEGSAPGTSES ATPESGPGSEPATSG SETPGSEPATSGSETP GSPAGSPTSTEEGTS ESATPESGPGTSTEPS EGSAPGTSTEPSEGS APGSPAGSPTSTEEG TSTEPSEGSAPGTSTE PSEGSAPGTSESATP ESGPGTSTEPSEGSA PGTSESATPESGPGS EPATSGSETPGTSTEP SEGSAPGTSTEPSEG SAPGTSESATPESGP GTSESATPESGPGSP AGSPTSTEEGTSESA TPESGPGSEPATSGS ETPGTSESATPESGP GTSTEPSEGSAPGTS TEPSEGSAPGTSTEP SEGSAPGTSTEPSEG SAPGTSESATPESGP GSPAGSPTSTEEGTS TEPSEGSAPGSPA GSPTSTEEGTSTEPSE GSAPGTSESATPESG PGSEPATSGSETPGT SESATPESGPGSEPA TSGSETPGTSESATPE SGPGTSTEPSEGSAP GTSESATPESGPGSP AGSPTSTEEGSPAGS PTSTEEGSPAGSPTST EEGTSESATPESGPG TSTEPSEGSAPGFPTI PLSRLFDNAMLRAH RLHQLAFDTYQEFEE | 775 | GGTAGCCCGGCTGGCTCTCCTACCTCTACTGAGGAAGGTACTTC TGAAAGCGCTACTCCTGAGTCTGGTCCAGGTACCTCTACTGAGC CGTCCGAAGGTAGCGCTCCAGGTAGCCCAGCAGGCTCTCCGAC TTCCACTGAGGAAGGTACTTCTACTGAACCTTCCGAAGGCAGC GCACCAGGTACCTCTACTGAACCTTCTGAGGGCAGCGCTCCAG GTACTTCTGAAAGCGCTACCCCGGAATCTGGCCCAGGTAGCGA ACCGGCTACTTCTGGTTCTGAAAACCCCAGGTAGCGAACCGGCT ACCTCCGGTTCTGAAACTCCAGGTAGCCCGGCAGGCTCTCCGAC CTCTACTGAGGAAGGTACTTCTGAAAGCGCAACCCCGGAGTCC GGCCCAGGTACCTCTACCGAACCGTCTGAGGGCAGCGCACCAG GTACTTCTACCGAACCGTCCGAGGGTAGCGCACCAGGTAGCCC AGCAGGTTCTCCTACCTCCACCGAGGAAGGTACTTCTACCGAAC CGTCCGAGGGTAGCGCACCAGGTACCTCTACTGAACCTTCTGA GGGCAGCGCTCCAGGTACTTCTGAAAGCGCTACCCCGGAGTCC GGTCCAGGTACTTCTACTGAACCGTCCGAAGGTAGCGCACCAG GTACTTCTGAAAGCGCAACCCCGGAATCCGGTCCAGGTAGCGA ACCGGCTACTTCTGGCTCTGAGACTCCAGGTACTTCTACCGAAC CGTCCGAAGGTAGCGCACCAGGTACTTCTACTGAACCGTCCGA AGGTAGCGCACCAGGTACTTCTGAAAGCGCAACCCCGGAATCC GGCCCAGGTACCTCTGAAAGCGCAACCCCGGAGTCCGGCCCAG GTAGCCCTGCTGGCTCTCCAACCTCCACCGAAGAAGGTACCTCT GAAAGCGCAACCCCTGAATCCGGCCCAGGTAGCGAACCGGCAA CCTCCGGTTCTGAAACCCCAGGTACCTCTGAAAGCGCTACTCCG GAGTCTGGCCCAGGTACCTCTACTGAACCGTCTGAGGGTAGCG CTCCAGGTACTTCTACTGAACCGTCCGAAGGTAGCGCACCAGG TACTTCTACCGAACCGTCCGAAGGCAGCGCTCCAGGTACCTCTA CTGAACCTTCCGAGGGCAGCGCTCCAGGTACCTCTACCGAACCT TCTGAAGGTAGCGCACCAGGTACTTCTACCGAACCGTCCGAGG GTAGCGCACCAGGTAGCCCAGCAGGTTCTCCTACCTCCACCGA GGAAGGTACTTCTACCGAACCGTCCGAGGGTAGCGCACCAGGT ACCTCTGAAAGCGCAACTCCTGAGTCTGGCCCAGGTAGCGAAC CTGCTACCTCCGGCTCTGAGACTCCAGGTACCTCTGAAAGCGCA ACCCCGGAATCTGGTCCAGGTAGCGAACCTGCAACCTCTGGCT CTGAAACCCCAGGTACCTCTGAAAGCGCTACTCCTGAATCTGGC CCAGGTACTTCTACTGAACCGTCCGAGGGCAGCGCACCAGGTA GCCCAGCAGGTTCTCCTACCTCCACCGAGGAAGGTACTTCTACC GAACCGTCCGAGGGTAGCGCACCAGGT AACCTCTGAAAGCGCAACCCCGGAGTCCGGCCCAGGTGGCTTCCCGACTCTCC CTGCTACCTCCGGCTCTGAGACTCCAGGTACCTCTGAAAGCGCA ACCCCGGAATCTGGTCCAGGTAGCGAACCTGCAACCTCTGGCT CTGAAACCCCAGGTACCTCTGAAAGCGCTACTCCTGAATCTGGC CCAGGTAGCCCCGGCT GGCTCTCCGACTTCCACCGAGGAAGGTAGCCCGGCTGGCTCTCC AACTTCTACTGAAGAAGGTAGCCCGGCAGGCTCTCCGACCTCTC ACTGAGGAAGGTACTTCTGAAAGCGCAACCCCGGAGTCCGGCC CAGGTACCTCTACCGAACCGTCTGAGGGCAGCGCACCAGGTTT | 776 |

TABLE 36-continued

Exemplary GHXTEN comprising growth hormones and two XTEN sequences

| GHXTEN Name* | Amino Acid Sequence | SEQ ID NO: | DNA Nucleotide Sequence | SEQ ID NO: |
|---|---|---|---|---|
| | AYIPKEQKYSFLQNP QTSLCFSESIPTPSNR EETQQKSNLELLRIS LLLIQSWLEPVQFLR SVFANSLVYGASDS NVYDLLKDLEEGIQT LMGRLEDGSPRTGQI FKQTYSKFDTNSHN DDALLKNYGLLYCF RKDMDKVETFLRIV QCRSVEGSCGFGGTS ESATPESGPGSEPAT SGSETPGTSESATPES GPGSEPATSGSETPG TSESATPESGPGTSTE PSEGSAPGSPAGSPT STEEGTSESATPESGP GSEPATSGSETPGTS ESATPESGPGSPAGS PTSTEEGSPAGSPTST EEGTSTEPSEGSAPG TSESATPESGPGTSES ATPESGPGTSESATP ESGPGSEPATSGSET PGSEPATSGSETPGSP AGSPTSTEEGTSTEPS EGSAPGTSTEPSEGS APGSEPATSGSETPG TSESATPESGPGTSTE PSEGSAP | | TCCGACTATTCCGCTGTCTCGTCTGTTTGATAATGCTATGCTGCG TGCCGCACCGTCTGCACCAGCTGGCCTTTGATACTTACCAGGAAT TTGAAGAAGCcTACATTCCTAAAGAGCAGAAGTACTCTTTCCTG CAAAACCCACAGACTTCTCTCTGCTTCAGCGAATCTATTCCGAC GCCTTCCAATCGCGAGGAAACTCAGCAAAAGTCCAATCTGGAA CTACTCCGCATTTCTCTGCTTCTGATTCAGAGCTGGCTAGAACC AGTGCAATTTCTGCGTTCCGTCTTCGCCAATAGCCTAGTTTATG GCGCATCCGACAGCAACGTATACGATCTCCTGAAAGATCTCGA GGAAGGCATTCAGACCCTGATGGGTCGTCTCGAGGATGGCTCT CCGCGTACTGGTCAGATCTTCAAGCAGACTTACTCTAAATTTGA TACTAACAGCCACAATGACGAGCTGCTTCTAAAAAACTATGGT CTGCTGTATTGTTTTCGTAAAGATATGGACAAAGTTGAAACCTT CCTGCGTATTGTTCAGTGTCGTTCCGTTGAGGGCAGCTGTGGTT TCTAAGGTGGTACCTCTGAAAGCGCAACTCCTGAGTCTGGCCCA GGTAGCGAACCTGCTACCTCCGGCTCTGAGACTCCAGGTACCTC TGAAAGCGCAACCCCGGAATCTGGTCCAGGTAGCGAACCTGCA ACCTCTGGCTCTGAAACCCCAGGTACCTCTGAAAGCGCTACTCC TGAATCTGGCCCAGGTACTTCTACTGAACCGTCCGAGGGCAGC GCACCAGGTAGCCTGCTCCAACCTCCACCGAAGAAG GTACCTCTGAAAGCGCAACCCCTGAATCCGGCCCAGGTAGCGA ACCGGCAACCTCCGGTTCTGAAACCCCAGGTACTTCTGAAAGC GCTACTCCTGAGTCCGGCCCAGGTAGCCCGGCTGGCTCTCCGAC TTCCACCGAGGAAGGTAGCCCGGCTGGCTCTCCAACTTCTACTG AAGAAGGTACTTCTACCGAACCTTCCGAGGGCAGCGCACCAGG TACTTCTGAAAGCGCTACCCCTGAGTCCGGCCCAGGTACTTCTG AAAGCGCTACTCCTGAATCCGGTCCAGGTACTTCTGAAAGCGCT ACCCCGGAATCTGGCCCAGGTAGCGAACCGGCTACTTCTGGTTC TGAAACCCCAGGTAGCGAACCGGCTACCTCCGGTTCTGAAACT CCAGGTAGCCCAGCAGGCTCTCCGACTTCCACTGAGGAAGTA CTTCTACTGAACCTTCCGAAGGCAGCGCACCAGGTACCTCTACT GAACCTTCTGAGGGCAGCGCTCCAGGTAGCGAACCTGCAACCT CTGGCTCTGAAACCCCAGGTACCTCTGAAAGCGCTACTCCTGAA TCTGGCCCAGGTACTTCTACTGAACCGTCCGAGGGCAGCGCAC CA | |
| AF576-hGH-AE288 | GSTSSTAESPGPGSTS STAESPGPGSTSESPS GTAPGSTSSTAESPG PGSTSSTAESPGPGTS TPESGSASPGSTSESP SGTAPGTSPSGESST APGSTSESPSGTAPG STSESPSGTAPGTSPS GESSTAPGSTSESPSG TAPGSTSESPSGTAP GTSPSGESSTAPGSTS ESPSGTAPGSTSESPS GTAPGSTSESPSGTA PGTSTPESGSASPGST SESPSGTAPGTSTPES GSASPGSTSSTAESP GPGSTSSTAESPGPG TSTPESGSASPGTSTP ESGSASPGSTSESPSG TAPGTSTPESGSASP GTSTPESGSASPGSTS ESPSGTAPGSTSESPS GTAPGSTSESPSGTA PGSTSSTAESPGPGTS TPESGSASPGTSTPES GSASPGSTSESPSGT APGSTSESPSGTAPG TSTPESGSASPGSTSE SPSGTAPGSTSESPSG TAPGTSTPESGSASP GTSPSGESSTAPGSTS STAESPGPGTSPSGES STAPGSTSSTAESPGP GTSTPESGSASPGSTS ESPSGTAPGSTSSTA ESPGPGTSTPESGSAS PGTSTPESGSASPGFP TIPLSRLFDNAMLRA HRLHQLAFDTYQEF | 777 | GGTTCTACTAGCTCTACCGCTGAATCTCCTGGCCCAGGTTCCAC TAGCTCTACCGCAGAATCTCCGGGCCCAGGTTCTACTAGCGAAT CCCCTTCTGGTACCGCTCCAGGTTCTACTAGCTCTACCGCTGAA TCTCCGGGTCCAGGTTCTACCAGCTCTACTGCAGAATCTCCTGG CCCAGGTACTTCTACTCCGGAAAGCGGTTCCGCTTCTCCAGGTT CTACCAGCGAATCTCCTTCTGGCACCGCTCCAGGTACCTCTCCT AGCGGCGAATCTTCTACCGCTCCAGGTTCTACTAGCGAATCTCC TTCTGGCACTGCACCAGGTTCTACCAGCGAATCTCCTTCTGGCA CCGCTCCAGGTACCTCTCTAGCGGCGAATCTTCTACCGCTCCA GGTTCTACTAGCGAATCTCCTTCTGGCACTGCACCAGGTTCTAC CAGCGAATCTCCTTCTGGCACCGCTCCAGGTACCTCTCCTAGCG GCGAATCTTCTACCGCTCCAGGTTCTACTAGCGAATCTCCTTCT GGCACTGCACCAGGTTCTACTAGCGAATCTCCTTCTGGCACTGC ACCAGGTTCTACCAGCGAATCTCCGTCTGGCACTGCACCAGGTA CCTCTACCCCTGAAAGCGGTTCCGCTTCTCCAGGTTCTACTAGC GAATCTCCTTCTGGTACCGCTCCAGGTACTTCTACCCCTGAAAG CGGCTCCGCTTCTCCAGGTTCCACTAGCTCTACCGCTGAATCTC CGGGTCCAGGTTCTACTAGCTCTACTGCAGAATCTCCTGGCCCA GGTACCTCTACTCCGGAAAGCGGCTCTGCATCTCCAGGTACTTC TACCCCTGAAAGCGGTTCTGCATCTCCAGGTTCTACTAGCGAAT CCCCGTCTGGTACCGCACCAGGTACTTCTACCCCGGAAAGCGG CTCTGCTTCTCCAGGTACTTCTACCCCGGAAAGCGGCTCCGCAT CTCCAGGTTCTACTAGCGAATCTCCTTCTGGTACCGCTCCAGGT TCTACCAGCGAATCCCCGTCTGGTACTGCTCCAGGTTCTACCAG CGAATCTCCTTCTGGTACTGCACCAGGTTCTACTAGCTCTACTG GAATCTCCTTCTGGTACTGCACCAGGTTCTACTAGCTCTACTG CAGAATCTCCTACCCCGGAAAGCGGCT CTGCTTCTCCAGGTACTTCTACCCCGGAAAGCGGCTCCGCAT TCTCCAGGTACCTCTACTCCGGAAAGCGGCT CTGCATCTCC AGGTTCTACTAGCGAATCTCCTTCTGGCACTGCACCAGGTTCTA CCAGCGAATCTCCGTCTGGCACTGCACCAGGTACCTCTACCCCT GAAAGCGGTTCCGCTTCTCCAGGTTCTACTAGCGAATCTCCTTC TGGCACTGCACCAGGTTCTACCAGCGAATCTCCGTCTGGCACTG CACCAGGTACCTCTACCCCTGAAAGCGGTTCCGCTTCTCCAGGT ACTTCTCCGAGCGGTGAATCTTCTACCGCACCAGGTTCTACTAG CTCTACCGCTGAATCTCCGGGCCCAGGTACTTCTCCGAGCGGTG AATCTTCTACTGCTCCAGGTTCCACTAGCTCTACTGCTGAATCT CCTGGCCCAGGTACTTCTACTCCGGAAAGCGGTTCCGCTTCTCC AGGTTCTACTAGCGAATCTCCGTCTGGCACCGCACCAGGTTCTA CTAGCTCTACTGCAGAATCTCCTGGCCCAGGTACCTCTACTCCG GAAAGCGGCTCTGCATCTCCAGGTACTTCTACCCCTGAAAGCG | 778 |

TABLE 36-continued

Exemplary GHXTEN comprising growth hormones and two XTEN sequences

| GHXTEN Name* | Amino Acid Sequence | SEQ ID NO: | DNA Nucleotide Sequence | SEQ ID NO: |
|---|---|---|---|---|
| | EEAYIPKEQKYSFLQ NPQTSLCFSESIPTPS NREETQQKSNLELLR ISLLLIQSWLEPVQFL RSVFANSLVYGASD SNVYDLLKDLEEGIQ TLMGRLEDGSPRTG QIFKQTYSKFDTNSH NDDALLKNYGLLYC FRKDMDKVETFLRI VQCRSVEGSCGFGG TSESATPESGPGSEP ATSGSETPGTSESAT PESGPGSEPATSGSE TPGTSESATPESGPG TSTEPSEGSAPGSPA GSPTSTEEGTSESATP ESGPGSEPATSGSET PGTSESATPESGPGSP AGSPTSTEEGSPAGS PTSTEEGTSTEPSEGS APGTSESATPESGPG TSESATPESGPGTSES ATPESGPGSEPATSG SETPGSEPATSGSETP GSPAGSPTSTEEGTS TEPSEGSAPGTSTEPS EGSAPGSEPATSGSE TPGTSESATPESGPG TSTEPSEGSAP | | GTTCTGCATCTCCAGGTTTTCCGACTATTCCGCTGTCTCGTCTGT TTGATAATGCTGCGTGCGTGCGCACCGTCTGCACCAGCTGGCC TTTGATACTTACCAGGAATTTGAAGAAGCcTACATTCCTAAAGA GCAGAAGTACTCTTTCCTGCAAAACCCACAGACTTCTCTCTGCT TCAGCGAATCTATTCCGACGCCTTCCAATCGCGAGGAAACTCA GCAAAAGTCCAATCTGGAACTACTCCGCATTTCTCTGCTTCTGA TTCAGAGCTGGCTAGAACCAGTGCAATTTCTGCGTTCCGTCTTC GCCAATAGCCTAGTTTATGGCGCATCCGACAGCAACGTATACG ATCTCCTGAAAGATCTCGAGGAAGGCATTCAGACCCTGATGGG TCGTCTCGAGGATGGCTCTCCGCGTACTGGTCAGATCTTCAAGC AGACTTACTCTAAATTTGATACTAACAGCCACAATGACGATGC GCTTCTAAAAAACTATGGTCTGCTGTATTGTTTTCGTAAAGATA TGGACAAAGTTGAAACCTTCCTGCGTATTGTTCAGTGTCGTTCC GTTGAGGGCAGCTGTGGTTTCTAAGGTGGTACCTCTGAAAGCG CAACTCCTGAGTCTGGCCCAGGTAGCGAACCTGCTACCTCCGGC TCTGAGACTCCAGGTACCTCTGAAAGCGCAACCCCGGAATCTG GTCCAGGTAGCGAACCTGCAACCTCTGGCTCTGAAACCCCAGG TACCTCTGAAAGCGCTACTCCTGAATCTGGCCCAGGTACTTCTA CTGAACCGTCCGAGGGCAGCGCACCAGGTAGCCCTGCTGGCTC TCCAACCTCCACCGAAGAAGGTACCTCTGAAAGCGCAACCCCT GAATCCGGCCCAGGTAGCGAACCGGCAACCTCCGGTTCTGAAA CCCCAGGTACTTCTGAAAGCGCTACTCCTGAGTCCGGCCCAGGT AGCCCGGCTGGCTCTCCGACTTCCACCGAGGAAGGTAGCCCGG CTGGCTCTCCAACTTCTACTGAAGAAGGTACTTCTACCGAACCT TCCGAGGCAGCGCACCAGGTACTTCTGAAAGCGCTACCCCTG AGTCCGGCCCAGGTACTTCTGAAAGCGCTACTCCTGAATCCGGT CCAGGTACTTCTGAAAGCGCTACCCCGGAATCTGGCCCAGGTA GCGAACCGGCTACTTCTGGTTCTGAAACCCCAGGTAGCGAACC GGCTACCTCCGGTTCTGAAACTCCAGGTAGCCCAGCAGGCTCT CGACTTCCACTGAGGAAGGTACTTCTACTGAACCTTCCGAAGGC AGCGCACCAGGTACCTCTACTGAACCTTCTGAGGGCAGCGCTC CAGGTAGCGAACCTGCAACCTCTGGCTCTGAAACCCCAGGTAC CTCTGAAAGCGCTACTCCTGAATCTGGCCCAGGTACTTCTACTG AACCGTCCGAGGGCAGCGCACCA | |
| AE624- hGH- AE288 | MAEPAGSPTSTEEGT PGSGTASSSPGSSTPS GATGSPGASPGTSST GSPGSPAGSPTSTEE GTSESATPESGPGTS TEPSEGSAPGSPAGS PTSTEEGTSTEPSEGS APGTSTEPSEGSAPG TSESATPESGPGSEP ATSGSETPGSEPATS GSETPGSPAGSPTST EEGTSESATPESGPG TSTEPSEGSAPGTSTE PSEGSAPGSPAGSPT STEEGTSTEPSEGSAP GTSTEPSEGSAPGTS ESATPESGPGTSTEPS EGSAPGTSESATPES GPGSEPATSGSETPG TSTEPSEGSAPGTSTE PSEGSAPGTSESATP ESGPGTSESATPESG PGSPAGSPTSTEEGT SESATPESGPGSEPA TSGSETPGTSESATPE SGPGTSTEPSEGSAP GTSTEPSEGSAPGTS TEPSEGSAPGTSTEPS EGSAPGTSTEPSEGS APGTSTEPSEGSAPG TSTEPSEGSAPGTSTE PSEGSAPGTSESATP ESGPGSEPATSGSET PGTSESATPESGPGS EPATSGSETPGTSES ATPESGPGTSTEPSE GSAPGTSESATPESG PGSPAGSPTSTEEGSP AGSPTSTEEGSPAGS | 779 | ATGGCTGAACCTGCTGGCTCTCCAACCTCCACTGAGGAAGGTA CCCGGGTAGCGGTACTGCTTCTTCCTCTCCAGGTAGCTCTACC CCTTCTGGTGCAACCGGCTCTCCAGGTGCTTCTCCGGGCACCAG CTCTACCGGTTCTCCAGGTAGCCCGGCTGGCTCTCCTACCTCTA CTGAGGAAGGTACTTCTGAAAGCGCTACTCCTGAGTCTGGTCCA GGTACCTCTACTGAACCGTCCGAAGGTAGCGCTCCAGGTAGCC CAGCAGGCTCTCCGACTTCCACTGAGGAAGGTACTTCTACTGAA CCTTCCGAAGGCAGCGCACCAGGTACCTCTACTGAACCTTCTGA GGGCAGCGCTCCAGGTACTTCTGAAAGCGCTACCCCGGAATCT GGCCCAGGTAGCGAACCGGCTACTTCTGGTTCTGAAACCCCAG GTAGCGAACCGGCTACCTCCGGTTCTGAAACTCCAGGTAGCCC GCAGGCTCTCCGACCTCTACTGAGGAAGGTACTTCTGAAAGC GCAACCCCGGAGTCCGGTCCAGGTACCTCTACCGAACCGTCTG AGGGCAGCGCACCAGGTACTTCTACCGAACCGTCCGAGGGTAG CGCACCAGGTAGCCCAGCAGGTTCTCCTACCTCCACCGAGGAA GGTACTTCTGAAAGCGCTACCCCGGAGTCCGGTCCAGGTACCT CTACTGAACCTTCTGAGGGCGCTCCAGGTACTTCTGAAAGC GCTACCCCGGAGTCGGTCCAGGTACTTCTACTGAACCGTCGA AGGTAGCGCACCAGGTACTTCTGAAAGCGCAACCCCTGAATCC GGTCCAGGTAGCGAACCGGCTACTTCTGGCTCTGAGACTCCAG GTACTTCTACCGAACCGTCCGAAGGTAGCGCACCAGGTACTTCT ACTGAACCGTCTGAAGGTAGCGCACCAGGTACTTCTGAAAGCG CAACCCCGGAATCCGGCCCAGGTACCTCTGAAAGCGCAACCCC GGAGTCCGGCCCAGGTAGCCCTGCTGGCTCTCAACCTCCACCG AAGAAGGTACCTCTGAAAGCGCAACCCCTGAATCCGGCCCAGG TAGCGAACCGGCTACCTCCGGTTCTGAAACCCCAGGTACCTCT GAAAGCGCTACTCCGGAGTCTGGCCCAGGTACCTCTACTGAAC CGTCTGAGGGTAGCGCTCCAGGTACTTCTACTGAACCGTCCGAA GGTAGCGCACCAGGTACTTCTACCGAACCGTCCGAAGGCAGCG CTCCAGGTACCTCTACTGAACCTTCCGAAGGTAGCGCACCAGGTACTTCTAC CGAACCGTCCGAAGGTAGCGCACCAGGTAGCCCAGCAGGTTCT CCTACCTCCACCGAGGAAGGTACTTCTACCGAACCGTCCGAGG GTAGCGCACCAGGTACTTCTGAAAGCGCAACCCCTGAGTCCTGG CCCAGGTAGCGAACCTGCTACCTCCGGCTCTGAGACTCCAGGT ACCTCTGAAAGCGCAACCCCGGAATCTGGTCCAGGTAGCGAAC CTGCAACCTCTGGCTCTGAAACCCCAGGTACCTCTGAAAGCGCT ACTCCTGAATCTGGCCCAGGTACTTCTACTGAACCGTCCGAGGG CAGCGCACCAGGTACTTCTGAAAGCGCTACTCCTGAGTCCGGC | 780 |

TABLE 36-continued

Exemplary GHXTEN comprising growth hormones and two XTEN sequences

| GHXTEN Name* | Amino Acid Sequence | SEQ ID NO: | DNA Nucleotide Sequence | SEQ ID NO: |
|---|---|---|---|---|
| | PTSTEEGTSESATPES GPGTSTEPSEGSAPG FPTIPLSRLFDNAML RAHRLHQLAFDTYQ EFEEAYIPKEQKYSF LQNPQTSLCFSESIPT PSNREETQQKSNLEL LRISLLLIQSWLEPVQ FLRSVFANSLVYGAS DSNVYDLLKDLEEGI QTLMGRLEDGSPRT GQIFKQTYSKFDTNS HNDDALLKNYGLLY CFRKDMDKVETFLRI VQCRSVEGSCGFGG TSESATPESGPGSEP ATSGSETPGTSESAT PESGPGSEPATSGSE TPGTSESATPESGPG TSTEPSEGSAPGSPA GSPTSTEEGTSESATP ESGPGSEPATSGSET PGTSESATPESGPGSP AGSPTSTEEGSPAGS PTSTEEGTSTEPSEGS APGTSESATPESGPG TSESATPESGPGTSES ATPESGPGSEPATSG SETPGSEPATSGSETP GSPAGSPTSTEEGTS TEPSEGSAPGTSTEPS EGSAPGSEPATSGSE TPGTSESATPESGPG TSTEPSEGSAP | | CCAGGTAGCCCGGCTGGCTCTCCGACTTCCACCGAGGAAGGTA GCCCGGCTGGCTCTCCAACTTCTACTGAAGAAGGTAGCCCGGC AGGCTCTCCGACCTCTACTGAGGAAGGTACTTCTGAAAGCGCA ACCCCGGAGTCCGGCCCAGGTACCTCTACCGAACCGTCTGAGG GCAGCGCACCAGGTTTTCCGACTATTCCGCTGTCTCGTCTGTTT GATAATGCTATGCTGCGTGCGCACCGTCTGCACCAGCTGGCCTT TGATACTTACCAGGAATTTGAAGAAGCcTACATTCCTAAAGAGC AGAAGTACTCTTTCCTGCAAAACCCACAGACTTCTCTCTGCTTC AGCGAATCTATTCCGACGCCTTCCAATGCGAGGAAACTCAGC AAAAGTCCAATCTGGAACTACTCCGCATTTCTCTGCTTCTGATT CAGAGCTGGCTAGAACCAGTGCAATTTCTGCGTTCCGTCTTCGC CAATAGCCTAGTTTATGGCGCATCCGACAGCAACGTATACGAT CTCCTGAAAGATCTCGAGGAAGGCATTCAGACCCTGATGGGTC GTCTCGAGGATGGCTCTCCGCGTACTGGTCAGATCTTCAAGCAG ACTTACTCTAAATTTGATACTAACAGCCACAATGACGATGCGCT TCTAAAAAACTATGGTCTGCTGTATTGTTTTCGTAAAGATATGG ACAAAGTTGAAACCTTCCTGCGTATTGTTCAGTGTCGTTCCGTT GAGGGCAGCTGTGGTTTCTAAGGTGGTACCTCTGAAAGCGCAA CTCCTGAGTCTGGCCAGGTAGCGAACCTGCTACCTCCGGCTCT GAGACTCCAGGTACCTCTGAAAGCGCAACCCCGGAATCTGGTC CAGGTAGCGAACCTGCAACCTCTGGCTCTGAAACCCCAGGTAC CTCTGAAAGCGCTACTCCTGAATCTGGCCCAGGTACTTCTACTG AACCGTCCGAGGGCAGCGCACCAGGTAGCCTGCTGGCTCTCC AACCTCCACCGAAGAAGGTACCTCTGAAAGCGCAACCCCTGAA TCCGGCCCAGGTAGCGAACCGGCAACCTCCGGTTCTGAAACCC CAGGTACTTCTGAAAGCGCTACTCCTGAGTCCGGCCCAGGTAG CCCGGCTGGCTCTCCGACTTCCACCGAGGAAGGTAGCCCGGCT GGCTCTCCAACTTCTACTGAAGAAGGTACTTCTACCGAACCTTC CGAGGGCAGCGCACCAGGTACTTCTGAAAGCGCTACCCCTGAG TCCGGCCCAGGTACTTCTGAAAGCGCTACTCCTGAATCCGGTCC AGGTACTTCTGAAAGCGCTACCCCGGAATCTGGCCCAGGTAGC GAACCGGCTACTTCTGGTTCTGAAACCCCAGGTAGCGAACCGG CTACCTCCGGTTCTGAAACTCCAGGTAGCCCAGCAGGCTCTCCG ACTTCCACTGAGGAAGGTACTTCTACTGAACCTTCCGAAGGCA GCGCACCAGGTACCTCTACTGAACCTTCTGAGGGCAGCGCTCC AGGTAGCGAACCTGCAACCTCTGGCTCTGAAACCCCAGGTACC TCTGAAAGCGCTACTCCTGAATCTGGCCCAGGTACTTCTACTGA ACCGTCCGAGGGCAGCGCACCA | |
| AD836- hGH- AE288 | GSSESGSSEGGPGSS ESGSSEGGPGESPGG SSGSESGSGGEPSES GSSGESPGGSSGSES GESPGGSSGSESGES ESGSSEGGPGSSESG SSEGGPGSSESGSSE GGPGESPGGSSGSES GESPGGSSGSESGES PGGSSGSESGSSESG SSEGGPGSSESGSSE GGPGSSESGSSEGGP GSSESGSSEGGPGSS ESGSSEGGPGSSESG SSEGGPGSSGGEPSES GSSGESPGGSSGSES GESPGGSSGSESGSG GEPSESGSSSGEGSS GPGESSGSSESGSSE GGPGSSGGEPSESGSS GSEGSSGPGESSGSS ESGSSEGGPGSSGEP SESGSSGGEPSESGSS GSGGEPSESGSSGSS ESGSSGGPGSSEGGP GSSEGGPGSSEGGP SESGSSGSGGEPSES GSSGSEGSSGPGESS GESPGGSSGSESGSE GSSPGGSSGSESGSE GSSGPGESSGGGEPS ES GSSGSESGSSEGGP GSSESGSSEGGPGES PGGSSGSESGSSEGG PGSSGEPSESGSSGSS ESGSSGSEGSSGPG | 781 | GGTTCCTCTGAAAGCGGTTCTTCCGAAGGTGGTCCAGGTTCCTC TGAAAGCGGTTCTTCTGAGGGTGGTCCAGGTGAATCTCCGGGT GGCTCCAGCGGTTCCGAGTCAGGTTCTGGTGGCGAACCTTCCGA GTCTGGTAGCTCAGGTGAATCTCCGGGTGGTTCTAGCGGTTCCG AGTCAGGTGAATCTCCGGGTGGTTCCAGCGGTTCTGAGTCAGGT TCCTCCGAAAGCGGTTCTTCTGAGGGCGGTCCAGGTTCCTCCGA AAGCGGTTCTTCGGAGGGCGGTCCAGGTTCTTCTGAAAGCGGTT CTTCCGAGGGCGGTCCAGGTGAATCTCCTGGTGGTTCCAGCGGT TCCGAGTCAGGTGAATCTCCAGGTGGCTCTAGCGGTTCCGAGTC AGGTGAATCTCCTGGTGGTTCTAGCGGTTCTGAATCAGGTTCCT CCGAAAGCGGTTCTTCTGAGGGCGGTCCAGGTTCCTCCGAAAG CGGTTCTTCCGAGGGCGGTCCAGGTTCTTCTGAAAGCGGTTCTT CCGAGGGCGGTCCAGGTTCCTCTGAAAGCGGTTCTTCTGAGGG CGGTCCAGGTTCTTCCGAAAGCGGTTCTTCGGAGGGCGGTCCAG GTTCTTCCGAAAGCGGTTCTTCTGAAGCGGTCCAGGTTCTGGT GGCGAACCGTCCGAGTCTGGTAGCTCAGGTGAATCTCCGGGTG GCTCTAGCGGTTCCGAGTCAGGTGAATCTCCTGGTGGTTCCAGC GGTTCCGAGTCAGGTTCCGGAACCGTCCGAATCTGGTA GCTCAGGTAGCGAAGGTTCTTCTGGTCCAGGCGAATCTTCAGGT TCCTCTGAAAGCGGTTCTTCTGAGGGCGGTCCAGGTTCCGGTGG CGAACCGTCCGAATCTGGTAGCTCAGGTAGCGAAGGTTCTTCTG GTCCAGGCGAATCTTCAGGTTCCTCTGAAAGCGGTTCTTCTGAG GGCGGTCCAGGTTCCGGTGGCGAACCTTCCGAATCTGGTAGCTC AGGTAATCTCCGGGTGGTTCTAGCGGTTCTGAGTCAGGTTCTG GTGGTGAACCTTCCGAGTCTGGTAGCTCAGGTTCTGGTGGCGAA CCATCCGAGTCTGGTAGCTCAGGTTCTTCCGAAAGCGGTTCTTC CGAAGGCGGTCCAGGTTCTGGTGGTGAACCGTCCGAATCTGGT AGCTCAGGTTCTGGTGGCGAACCATCCGAATCTGGTAGCTCAG GTAGCGAAGGTTCTTCTGGTCCTGGCGAATCTTCAGGTGAATCT CCAGGTGGCTCTAGCGGTCCGAATCAGGTAGCGAAGGTTCTTC CGGTCCAGGTGAATCTTCAGGTAGCGAAGGTTCTTCTGGTCCTG GTGAATCTCCAGGTTCCGGTGGCGAACCATCCGAATCTGGTAGC TCAGGTTCCTCTGAAAGCGGTTCTTCCGAAGGTGGTCCAGGTTC CTCTGAAAGCGGTTCTTCCGAGGGTGGTCCAGGTGAATCTCCGG GTGGCTCCAGCGGTTCCGAGTCAGGTTCTGGTGGCGAACCATCC | 782 |

TABLE 36-continued

Exemplary GHXTEN comprising growth hormones and two XTEN sequences

| GHXTEN Name* | Amino Acid Sequence | SEQ ID NO: | DNA Nucleotide Sequence | SEQ ID NO: |
|---|---|---|---|---|
| | ESSGESPGGSSGSES<br>GSEGSSGPGSSESGS<br>SEGGPGSGGEPSESG<br>SSGSEGSSGPGESSG<br>SEGSSGPGESSGSEG<br>SSGPGESSGSGGEPS<br>ESGSSGGGEPSESG<br>SSGESPGGSSGSESG<br>ESPGGSSGSESGSGG<br>EPSESGSSGSEGSSGP<br>GESSGESPGGSSGSE<br>SGSSSESGSSEGGPGS<br>SESGSSEGGPGSSES<br>GSSEGGPGSGGEPSE<br>SGSSGSESGSSEGG<br>PGESPGGSSGSESGS<br>GGEPSESGSSGSSES<br>GSSEGGPGESPGGSS<br>GSESGSSGGEPSESGS<br>SGESPGGSSGSESGS<br>GGEPSESGSSGFPTIP<br>LSRLFDNAMLRAHR<br>LHQLAFDTYQEFEE<br>AYIPKEQKYSFLQNP<br>QTSLCFSESIPTPSNR<br>EETQQKSNLELLRIS<br>LLLIQSWLEPVQFLR<br>SVFANSLVYGASDS<br>NVYDLLKDLEEGIQT<br>LMGRLEDGSPRTGQI<br>FKQTYSKFDTNSHN<br>DDALLKNYGLLYCF<br>RKDMDKVETFLRIV<br>QCRSVEGSCGFGGTS<br>ESATPESGPGSEPAT<br>SGSETPGTSESATPES<br>GPGSEPATSGSETPG<br>TSESATPESGPGSTE<br>PSEGSAPGSPAGSPT<br>STEEGTSESATPESGP<br>GSEPATSGSETPGTS<br>ESATPESGPGSPAGS<br>PTSTEEGSPAGSPTST<br>EEGTSTEPSEGSAPG<br>TSESATPESGPGTSES<br>ATPESGPGTSESATP<br>ESGPGSEPATSGSET<br>PGSEPATSGSETPGSP<br>AGSPTSTEEGTSTEPS<br>EGSAPGTSTEPSEGS<br>APGSEPATSGSETPG<br>TSESATPESGPGTSTE<br>PSEGSAP | | GAATCTGGTAGCTCAGGTAGCGAAGGTTCTTCTGGTCCTGGCGA<br>ATCTTCAGGTGAATCTCCAGGTGCTCTAGCGGTTCCGAATCAG<br>GTAGCGAAGGTTCTTCCGGTCCAGGTTCCTCTGAAAGCGGTTCT<br>TCTGAGGGCGGTCCAGGTTCTGGTGGCGAACCATCTGAATCTG<br>GTAGCTCAGGTAGCGAAGGTTCTTCCGGTCCGGGTGAATCTTCA<br>GGTAGCGAAGGTTCTTCCGGTCCAGGTGAATCTTCAGGTAGCG<br>AAGGTTCTTCTGGTCCTGGTGAATCCTCAGGTTCCGGTGGCGAA<br>CCATCTGAATCTGGTAGCTCAGGTTCTGGTGGCGAACCATCCGA<br>ATCTGGTAGCTCAGGTGAATCTCCGGGTGGCTCCAGCGGTTCT<br>AATCAGGTGAATCTCCTGGTGGCTCCAGCGGTTCTGAGTCAGGT<br>TCTGGTGGCGAACCATCCGAATCTGGTAGCTCAGGTAGCGAAG<br>GTTCTTCTGGTCCTGGCGAATCTTCAGGTGAATCTCCAGGTGGC<br>TCTAGCGGTTCCGAATCAGGTTCCTCTGAAAGCGGTTCTTCTGA<br>GGGCGGTCCAGGTTCTTCCGAAAGCGGTTCTTCCGAGGGCGGT<br>CCAGGTTCTTCCGAAAGCGGTTCTTCTGAAGGCGGTCCAGGTTC<br>TGGTGGCGAACCGTCCGAATCTGGTAGCTCAGGTTCCTCCGAA<br>AGCGGTTCTTCTGAAGGTGGTCCAGGTGAATCTCCAGGTGGTTC<br>TAGCGGTTCTGAATCAGGTTCTGGTGGCGAACCGTCCGAATCTG<br>GTAGCTCAGGTTCCTCCGAAAGCGGTTCTTCTGAAGGTGGTCCA<br>GGTGAATCTCCAGGTGGTTCTAGCGGTTCTGAATCAGGTTCTGG<br>TGGCGAACCGTCGAATCTGGTAGCTCAGGTGAATCTCCTGGTG<br>GTTCCAGCGGTTCCGAGTCAGGTTCTGGTGGCGAACCTTCCGAA<br>TCTGGTAGCTCAGGTTTTCCGACTATTCCGCTGTCTCGTCTGTTT<br>GATAATGCTATGCTGCGTGCGCACCGTCTGCACCAGCTGGCCTT<br>TGATACTTACCAGGAATTTGAAGAAGCTACATTCCTAAAGAGC<br>AGAAGTACTCTTTCCTGCAAAACCCACAGACTTCTCTCTGCTTC<br>AGCGAATCTATTCCAGACGCCTTCCAATCGCGAGGAAACTCAGC<br>AAAAGTCCAATCTGGAACTACTCCGCATTTCTCTGCTTCTGATT<br>CAGAGCTGGCTAGAACCAGTGCAATTTCTGCGTTCCGTCTTCGC<br>CAATAGCCTAGTTTATGGCGCATCCGACAGCAACGTATACGAT<br>CTCCTGAAAGATCTCGAGGAAGGCATTCAGACCCTGATGGGTC<br>GTCTCGAGGATGGCTCTCCGCGTACTGGTCAGATCTTCAAGCAG<br>ACTTACTCTAAATTTGATACTAACAGCCACAATGACGATGCGCT<br>TCTAAAAAACTATGGTCTGCTGTATTGTTTCGTAAAGATATGG<br>ACAAAGTTGAAACCTTCCTGCGTATTGTTCAGTGTCGTTCCGTT<br>GAGGGCAGCTGTGGTTCTAAGGTGGTACCTCTGAAAGCGCAA<br>CTCCTGAGTCTGGCCCAGGTAGCGAACCTGCTACCTCCGGCTCT<br>GAGACTCCAGGTACCTCTGAAAGCGCAACCCCGGAATCTGGTC<br>CAGGTAGCGAACCTGCAACCTCTGGCTCTGAAACCCCAGGTAC<br>CTCTGAAAGCGCTACTCCTGAATCTGGCCCAGGTACTTCTACTG<br>AACCGTCCGAGGGCAGCGCACCAGGTAGCCCTGCTGGCTCTCC<br>AACCTCCACCGAAGAAGGTACCTCTGAAAGCGCAACCCCTGAA<br>TCCGGCCCAGGTAGCGAACCGGCAACCTCCGGTTCTGAAACCC<br>CAGGTACTTCTGAAAGCGCTACTCCTGAGTCCGGCCCAGGTAG<br>CCCGGCTGGCTCTCCGACTTCCACCGAGGAAGGTAGCCCGGCT<br>GGCTCTCCAACTTCTACTGAAGAAGGTACTTCTACCGAACCTTC<br>CGAGGGCAGCGCACCAGGTACTTCTGAAAGCGCTACCCCTGAG<br>TCCGGCCCAGGTACTTCTGAAAGCGCTACTCCTGAATCCGGTCC<br>AGGTACTTCTGAAAGCGCTACCCCGGAATCTGGCCCAGGTAGC<br>GAACCGGCTACTTCTGGTTCTGAAACCCCAGGTAGCGAACCGG<br>CTACCTCCGGTTCTGAAACTCCAGGTAGCCCAGCAGGCTCTCCG<br>ACTTCCACTGAGGAAGGTACTTCTACTGAACCTTCCGAAGGCA<br>GCGCACCAGGTACCTCTACTGAACCTTCTGAGGGCAGCGCTCC<br>AGGTAGCGAACCTGCAACCTCTGGCTCTGAAACCCCAGGTACC<br>TCTGAAAGCGCTACTCCTGAATCTGGCCCAGGTACTTCTACTGA<br>ACCGTCCGAGGGCAGCGCACCA | |
| AE864-<br>hGH-<br>AE288 | GSPAGSPTSTEEGTS<br>ESATPESGPGTSTEPS<br>EGSAPGSPAGSPTST<br>EEGTSTEPSEGSAPG<br>TSTEPSEGSAPGTSES<br>ATPESGPGSEPATSG<br>SETPGSEPATSGSETP<br>GSPAGSPTSTEEGTS<br>ESATPESGPGTSTEPS<br>EGSAPGTSTEPSEGS<br>APGSPAGSPTSTEEG<br>TSTEPSEGSAPGTSTE<br>PSEGSAPGTSESATP<br>ESGPGTSTEPSEGSA<br>PGTSESATPESGPGS<br>EPATSGSETPGTSTEP<br>SEGSAPGTSTEPSEG | 783 | GGTAGCCCGGCTGGCTCTCCTACCTCTACTGAGGAAGGTACTTC<br>TGAAAGCGCTACTCCTGAGTCTGGTCCAGGTACCTCTACTGAAC<br>CGTCCGAAGGTAGCGCTCCAGGTAGCCCAGCAGGCTCTCCGAC<br>TTCCACTGAGGAAGGTACTTCTACTGAACCTTCCGAAGGCAGC<br>GCACCAGGTACCTCTACTGAACCTTCTGAGGGCAGCGCTCCAG<br>GTACTTCTGAAAGCGCTACCCCGGAATCTGGCCCAGGTAGCGA<br>ACCGGCTACTTCTGGTTCTGAAACCCCAGGTAGCGAACCGGCT<br>ACCTCCGGTTCTGAAACTCCGGCAGGCTCTCCGAC<br>CTCTACTGAGGAAGGTACTTCTGAAAGCGCAACCCCGGAGTCC<br>GGCCCAGGTACCTCTACCGAACCGTCTGAGGGCAGCGCACCAG<br>GTACTTCTACCGAACCGTCCGAGGGTAGCGCACCAGGTAGCCC<br>AGCAGGTTCTCCTACTAGCACCGAGGAAGGTACTTCTACCGAA<br>CGTCCGAGGGTAGCGCACCAGGTACCTCTACTGAACCTTCTGA<br>GGGCAGCGCTCCAGGTACTTCTGAAAGCGCTACCCCGGAGTCC<br>GGTCCAGGTACTTCTACTGAACCGTCCGAAGGTAGCGCACCAG<br>GTACTTCTGAAAGCGCAACCCCTGAATCCGGTCCAGGTAGCGA<br>ACCGGCTACTTCTGGCTCTGAGACTCCAGGTACCTCTACCGAAC | 784 |

TABLE 36-continued

Exemplary GHXTEN comprising growth hormones and two XTEN sequences

| GHXTEN Name* | Amino Acid Sequence | SEQ ID NO: | DNA Nucleotide Sequence | SEQ ID NO: |
|---|---|---|---|---|
| | SAPGTSESATPESGP | | CGTCCGAAGGTAGCGCACCAGGTACTTCTACTGAACCGTCTGA | |
| | GTSESATPESGPGSP | | AGGTAGCGCACCAGGTACTTCTGAAAGCGCAACCCCGGAATCC | |
| | AGSPTSTEEGTSESA | | GGCCCAGGTACCTCTGAAAGCGCAACCCCGGAGTCCGGCCCAG | |
| | TPESGPGSEPATSGS | | GTAGCCCTGCTGGCTCTCCAACCTCCACCGAAGAAGGTACCTCT | |
| | ETPGTSESATPESGP | | GAAAGCGCAACCCCTGAATCCGGCCCAGGTAGCGAACCGGCAA | |
| | GTSTEPSEGSAPGTS | | CCTCCGGTTCTGAAACCCCAGGTACCTCTGAAAGCGCTACTCCG | |
| | TEPSEGSAPGTSTEPS | | GAGTCTGGCCCAGGTACCTCTACTGAACCGTCTGAGGGTAGCG | |
| | EGSAPGTSTEPSEGS | | CTCCAGGTACTTCTACTGAACCGTCCGAAGGTAGCGCACCAGG | |
| | APGTSTEPSEGSAPG | | TACTTCTACCGAACCGTCCGAAGGCAGCGCTCCAGGTACCTCTA | |
| | TSTEPSEGSAPGSPA | | CTGAACCTTCCGAGGGCAGCGCTCCAGGTACCTCTACCGAACCT | |
| | GSPTSTEEGTSTEPSE | | TCTGAAGGTAGCGCACCAGGTACTTCTACCGAACCGTCCGAGG | |
| | GSAPGTSESATPESG | | GTAGCGCACCAGGTAGCCCAGCAGGTTCCTCCTACCTCCACCGA | |
| | PGSEPATSGSETPGT | | GGAAGGTACTTCTACCGAACCGTCCGAGGGTAGCGCACCAGGT | |
| | SESATPESGPGSEPA | | ACCTCTGAAAGCGCAACTCCTGAGTCTGGCCCAGGTAGCGAAC | |
| | TSGSETPGTSESATPE | | CTGCTACCTCCGGCTCTGAGACTCCAGGTACCTCTGAAAGCGCA | |
| | SGPGTSTEPSEGSAP | | ACCCCGGAATCTGGTCCAGGTAGCGAACCTGCAACCTCTGGCT | |
| | GTSESATPESGPGSP | | CTGAAACCCCAGGTACCTCTGAAAGCGCTACTCCTGAATCTGGC | |
| | AGSPTSTEEGSPAGS | | CCAGGTACTTCTACTGAACCGTCCGAGGGCAGCGCACCAGGTA | |
| | PTSTEEGSPAGSPTST | | CTTCTGAAAGCGCTACTCCTGAGTCCGGCCCAGGTAGCCCGGCT | |
| | EEGTSESATPESGPG | | GGCTCTCCGACTTCCACCGAGGAAGGTAGCCCGGCTGGCTCTCC | |
| | TSTEPSEGSAPGTSES | | AACTTCTACTGAAGAAGGTAGCCCGGCAGGCTCTCCGACCTCT | |
| | ATPESGPGSEPATSG | | ACTGAGGAAGGTACTTCTGAAAGCGCAACCCCGGAGTCCGGCC | |
| | SETPGTSESATPESGP | | CAGGTACCTCTACCGAACCGTCTGAGGGCAGCGCACCAGGTAC | |
| | GSEPATSGSETPGTS | | CTCTGAAAGCGCAACTCCTGAGTCTGGCCCAGGTAGCGAACCT | |
| | ESATPESGPGTSTEPS | | GCTACCTCCGGCTCTGAGACTCCAGGTACCTCTGAAAGCGCAA | |
| | EGSAPGSPAGSPTST | | CCCCGGAATCTGGTCCAGGTAGCGAACCTGCAACCTCTGGCTCT | |
| | EEGTSESATPESGPG | | GAAACCCCAGGTACCTCTGAAAGCGCTACTCCTGAATCTGGCC | |
| | SEPATSGSETPGTSES | | CAGGTACTTCTACTGAACCGTCCGAGGGCAGCGCACCAGGTAG | |
| | ATPESGPGSPAGSPT | | CCCTGCTGGCTCTCCAACCTCCACCGAAGAAGGTACCTCTGAAA | |
| | STEEGSPAGSPTSTEE | | GCGCAACCCCTGAATCCGGCCCAGGTAGCGAACCGGCAACCTC | |
| | GTSTEPSEGSAPGTS | | CGGTTCTGAAACCCCAGGTACTTCTGAAAGCGCTACTCCTGAGT | |
| | ESATPESGPGTSESA | | CCGGCCCAGGTAGCCCGGCTGGCTCTCCGACTTCCACCGAGGA | |
| | TPESGPGTSESATPES | | AGGTAGCCCGGCTGGCTCTCCAACTTCTACTGAAGAAGGTACTT | |
| | GPGSEPATSGSETPG | | CTACCGAACCTTCCGAGGGCAGCGCACCAGGTACTTCTGAAAG | |
| | SEPATSGSETPGSPA | | CGCTACCCCTGAGTCCGCCCAGGTACTTCTGAAAGCGCTACTC | |
| | GSPTSTEEGTSTEPSE | | CTGAATCCGGTCCAGGTACTTCTGAAAGCGCTACCCCGGAATCT | |
| | GSAPGTSTEPSEGSA | | GGCCCAGGTAGCGAACCGGCTACTTCTGGTTCTGAAACCCCAG | |
| | PGSEPATSGSETPGT | | GTAGCGAACCTGCTACCTCCGGTTCTGAAACTCCAGGTAGCCC | |
| | SESATPESGPGTSTEP | | AGCAGGTCTCCGACTTCCACTGAGGAAGGTACTTCTACTGAAC | |
| | SEGSAPGFPTIPLSRL | | CTTCCGAAGGCAGCGCACCAGGTACCTCTACTGAACCTTCTGAG | |
| | FDNAMLRAHRLHQL | | GGCAGCGCTCCAGGTAGCGAACCTGCAACCTCTGGCTCTGAAA | |
| | AFDTYQEFEEAYIPK | | CCCCAGGTACCTCTGAAAGCGCTACTCCTGAATCTGGCCCAGGT | |
| | EQKYSFLQNPQTSLC | | ACTTCTACTGAACCGTCCGAGGGCAGCGCACCAGGTTTTCCGAC | |
| | FSESIPTPSNREETQQ | | TATTCCGCTGTCTCGTCTGTTTGATAATGCTATGCTGCGTGCGC | |
| | KSNLELLRISLLLIQS | | ACCGTCTGCACCAGCTGGCCTTTGATACTTACCAGGAATTTGAA | |
| | WLEPVQFLRSVFAN | | GAAGCcTACATTCCTAAAGAGCAGAAGTACTCTTTCCTGCAAAA | |
| | SLVYGASDSNVYDL | | CCCACAGACTTCTCTCTGCTTCAGCGAATCTATTCCGACGCCTT | |
| | LKDLEEGIQTLMGRL | | CCAATCGCGAGGAAACTCAGCAAAAGTCCAATCTGGAACTACT | |
| | EDGSPRTGQIFKQTY | | CCGCATTTCTCTGCTTGATTCAGAGCTGGCTAGAACCAGTGC | |
| | SKFDTNSHNDDALL | | AATTTCTGCGTTCCGTCTTCGCCAATAGCCTAGTTTATGGCGCA | |
| | KNYGLLYCFRKDMD | | TCCGACAGCAACGTATACGATCTCCTGAAAGATCTCGAGGAAG | |
| | KVETFLRIVQCRSVE | | GCATTCAGACCCTGATGGGTCGTCTCGAGGATGGCTCTCCGCGT | |
| | GSCGFGGTSESATPE | | ACTGGTCAGATCTTCAAGCAGACTTACTCTAAATTTGATACTAA | |
| | SGPGSEPATSGSETP | | CAGCCACAATGACGATGCGTTCTCTAAAAAACTATGGTCTGCTGT | |
| | GTSESATPESGPGSE | | ATTGTTTTCGTAAAGATATGGACAAAGTTGAAACCTTCCTGCGT | |
| | PATSGSETPGTSESA | | ATTGTTCAGTGTCGTTCCGTTGAGGGCAGCTGTGGTTTCTAAGG | |
| | TPESGPGTSTEPSEGS | | TGGTACCTCTGAAAGCGCAACTCCTGAGTCTGGCCCAGGTAGC | |
| | APGSPAGSPTSTEEG | | GAACCTGCTACCTCCGGCTCTGAGACTCCAGGTACCTCTGAAAG | |
| | TSESATPESGPGSEP | | CGCAACCCCGGAATCTGGTCCAGGTAGCGAACCTGCAACCTCT | |
| | ATSGSETPGTSESAT | | GGCTCTGAAACCCCAGGTACCTCTGAAAGCGCTACTCCTGAATC | |
| | PESGPGSPAGSPTSTE | | TGGCCCAGGTACTTCTACTGAACCGTCCGAGGGCAGCGCACCA | |
| | EGSPAGSPTSTEEGT | | GGTAGCCCTGCTGGCTCTCCAACCTCCACCGAAGAAGGTACCTC | |
| | STEPSEGSAPGTSES | | TGAAAGCGCAACCCCTGAATCCGGCCCAGGTAGCGAACCGGCA | |
| | ATPESGPGTSESATP | | ACCTCCGGTTCTGAAACCCCAGGTACTTCTGAAAGCGCTACTCC | |
| | ESGPGTSESATPESG | | TGAGTCCGGCCCAGGTAGCCCGGCTGGCTCTCCGACTTCCACCG | |
| | PGSEPATSGSETPGS | | AGGAAGGTAGCCCGGCTGGCTCTCCAACTTCTACTGAAGAAGG | |
| | EPATSGSETPGSPAG | | TACTTCTACCGAACCTTCCGAGGGCAGCGCACCAGGTACTTCTG | |
| | SPTSTEEGTSTEPSEG | | AAAGCGCTACCCCTGAGTCCGGCCCAGGTACTTCTGAAAGCGC | |
| | SAPGTSTEPSEGSAP | | TACTCCTGAATCCGGTCCAGGTACTTCTGAAAGCGCTACCCCGG | |
| | GSEPATSGSETPGTS | | AATCTGGCCCAGGTAGCGAACCGGCTACTTCTGGTTCTGAAACC | |

TABLE 36-continued

Exemplary GHXTEN comprising growth hormones and two XTEN sequences

| GHXTEN Name* | Amino Acid Sequence | SEQ ID NO: | DNA Nucleotide Sequence | SEQ ID NO: |
|---|---|---|---|---|
| | ESATPESGPGTSTEPS EGSAP | | CCAGGTAGCGAACCGGCTACCTCCGGTTCTGAAACTCCAGGTA GCCCAGCAGGCTCTCCGACTTCCACTGAGGAAGGTACTTCTACT GAACCTTCCGAAGGCAGCGCACCAGGTACCTCTACTGAACCTT CTGAGGGCAGCGCTCCAGGTAGCGAACCTGCAACCTCTGGCTC TGAAACCCCAGGTACCTCTGAAAGCGCTACTCCTGAATCTGGCC CAGGTACTTCTACTGAACCGTCCGAGGGCAGCGCACCA | |
| AF864-hGH-AE288 | GSTSESPSGTAPGTSP SGESSTAPGSTSESPS GTAPGSTSESPSGTA PGTSTPESGSASPGTS TPESGSASPGSTSESP SGTAPGSTSESPSGT APGTSPSGESSTAPG STSESPSGTAPGTSPS GESSTAPGTSPSGESS TAPGSTSSTAESPGP GTSPSGESSTAPGTSP SGESSTAPGSTSSTA ESPGPGTSTPESGSAS PGTSTPESGSASPGST SESPSGTAPGSTSESP SGTAPGTSTPESGSA SPGSTSSTAESPGPGT STPESGSASPGSTSES PSGTAPGTSPSGESST APGSTSSTAESPGPG TSPSGESSTAPGTSTP ESGSASPGSTSSTAES PGPGSTSSTAESPGP GSTSSTAESPGPGSTS STAESPGPGTSPSGES STAPGSTSESPSGTAP GSTSESPSGTAPGTS TPESGPXXXGASASG APSTXXXXSESPSGT APGSTSESPSGTAPG STSESPSGTAPGTSE SPSGTAPGSTSESPSG TAPGSTSESPSGTAP GTSTPESGSASPGTSP SGESSTAPGTSPSGES STAPGSTSSTAESPGP GTSPSGESSTAPGTS TPESGSASPGSTSESP SGTAPGSTSESPSGT APGTSPSGESSTAPG STSESPSGTAPGTSTP ESGSASPGTSTPESGS ASPGSTSESPSGTAP GTSTPESGSASPGSTS STAESPGPGSTSESPS GTAPGSTSESPSGTA PGTSPSGESSTAPGST SSTAESPGPGTSPSGE SSTAPGTSTPESGSAS PGTSPSGESSTAPGTS PSGESSTAPGTSPSGE SSTAPGSTSSTAESPG PGSTSSTAESPGPGTS PSGESSTAPGSPSAS TGTGPGSSTPSGATG SPGSSTPSGATGSPG FPTIPLSRLFDNAML RAHRLHQLAFDTYQ EFEEAYIPKEQKYSF LQNPQTSLCFSESIPT PSNREETQQKSNLEL LRISLLLIQSWLEPVQ FLRSVFANSLVYGAS DSNVYDLLKDLEEGI QTLMGRLEDGSPRT GQIFKQTYSKFDTNS HNDDALLKNYGLLY | 785 | GGTTCTACCAGCGAATCTCCTTCTGGCACCGCTCCAGGTACCTC TCCTAGCGGCGAATCTTCTACCGCTCCAGGTTCTACTAGCGAAT CTCCTTCTGGCACTGCACCAGGTTCTACTAGCGAATCCCCGTCT GGTACTGCTCCAGGTACTTCTACTCCTGAAAGCGGTTCCGCTTC TCCAGGTACCTCTACTCCGGAAAGCGGTTCTGCATCTCCAGGTT CTACCAGCGAATCTCCTTCTGGCACCGCTCCAGGTTCTACTAGC GAATCCCCGTCTGGTACCGCACCAGGTACTTCTCCTAGCGGCGA ATCTTCTACCGCACCAGGTTCTACTAGCGAATCTCCGTCTGGCA CTGCTCCAGGTACTTCTCCTAGCGGTGAATCTTCTACCGCTCCA GGTACTTCCCTAGCGGCGAATCTTCTACCGCTCCAGGTTCTAC TAGCTCTACTGCAGAATCTCCGGGCCCAGGTACCTCTCCTAGCG GTGAATCTTCTACCGCTCCAGGTACTTCTCCGAGCGGTGAATCT TCTACCGCTCCAGGTTCTACTAGCTCTACTGCAGAATCTCCTGG CCCAGGTACCTCTACTCCGGAAAGCGGCTCTGCATCTCCAGGTA CTTCTACCCCTGAAAGCGGTTCTGCATCTCCAGGTTCTACTAGC GAATCTCCTTCTGGCACTGCACCAGGTTCTACCAGCGAATCTCC GTCTGGCACTGCACCAGGTACCTCTACCCCTGAAAGCGGTTCCG CTTCTCCAGGTTCTACCAGCTCTACCGCAGAATCTCCTGGTCCA GGTACCTCTACTCCGGAAAGCGGCTCTGCATCTCCAGGTTCTAC TAGCGAATCTCCTTCTGGCACTGCACCAGGTACTTCTCCGAGCG GTGAATCTTCTACCGCACCAGGTTCTACTAGCTCTACCGCTGAA TCTCCGGGCCCAGGTACTTCTCCGAGCGGTGAATCTTCTACTGC TCCAGGTACCTCTACTCCTGAAAGCGGTTCTGCATCTCCAGGTT CCACTAGCTCTACCGCAGAATCTCCGGGCCCAGGTTCTACTAGC TCTACTGCTGAATCTCCGGGTCCAGGTTCTACTAGCTCTACTGC TGAATCTCCGGGTCCAGGTTCTACCAGCTCTACTGCTGAATCTC CTGGTCCAGGTACCTCCCCGAGCGGTGAATCTTCTACTGCACCA GGTTCTACTAGCGAATCTCCTTCTGGCACTGCACCAGGTTCTAC CAGCGAATCTCCTTCTGGCACTGCACCAGGTTCTACCAGCTG AAAGCGGTCCXXXXXXXXXXXXTGCAAGCGCAAGCGGCGCGC CAAGCACGGGAXXXXXXXXXTAGCGAATCTCCTTCTGGTACCGC TCCAGGTTCTACCAGCGAATCCCCGTCTGGTACTGCTCCAGGTT CTACCAGCGAATCTCCTTCTGGTACTGCACCAGGTTCTACTAGC GAATCTCCTTCTGGTACCGCTCCAGGTTCTACCAGCGAATCCCC GTCTGGTACTGCTCCAGGTTCTACCAGCGAATCTCCTTCTGGTA CTGCACCAGGTACTTCTACTCCGGAAAGCGGTTCCGCATCTCCA GGTACTTCTCTAGCGGTGAATCTTCTACTGCTCCAGGTACCTC TCCTAGCGGCGAATCTTCTACTGCTCCAGGTTCTACCAGCTCTA CTGCTGAATCTCCGGGTCCAGGTACTTCCCCGAGCGGTGAATCT TCTACTGCACCAGGTACTTCTACTCCGGAAAGCGGTTCCGCTTC TCCAGGTTCTACCAGCGAATCTCCTTCTGGCACCGCTCCAGGTT CTACTAGCGAATCCCCGTCTGGTACCGCACCAGGTACTTCTCCT AGCGGCGAATCTTCTACCGCACCAGGTTCTACTAGCGAATCCCC GTCTGGTACCGCACCAGGTACTTCTACCCCGGAAAGCGGCTCTG CTTCTCCAGGTACTTCTACCCCGGAAAGCGGCTCCGCATCTCCA GGTTCTACTAGCGAATCTCCTTCTGGTACCGCTCCAGGTACTTC TACCCCTGAAAGCGGCTCCGCTTCTCCAGGTTCCACTAGCTCTA CCGCTGAATCTCCGGGTCCAGGTTCTACCAGCGAATCTCCTTCT GGCACCGCTCCAGGTTCTACTAGCGAATCCCCGTCTGGTACCGC ACCAGGTACTTCTCCTAGCGGCGAATCTTCTACCGCACCAGGTT CTACCAGCTCTACTGCTGAATCTCCGGGTCCAGGTACTTCCCCG AGCGGTGAATCTTCTACTGCACCAGGTACTTCTACTCCGGAAAG CGGTTCCGCTTCTCCAGGTACCTCCCCTAGCGGCGAATCTTCTA CTGCTCCAGGTTCTCCTAGCGGCGAATCTTCTACCGCTCCA GGTACCTCCCCTAGCGGTGAATCTTCTACCGCACCAGGTTCTAC TAGCTCTACTGCTGAATCTCCGGGTCCAGGTTCTACCAGCTCTA CTGCTGAATCTCCTGGTCCAGGTACCTCCCGAGCGGTGAATCT TCTACTGCACCGCTAGCGAATCTCCTTCTGGTACCGC CCCAGGTAGCTCTACTCCGTCTGGTGCAACTGGCTCTCCAGGTA GCTACTCCGTCGGTGCAACCGGCTCCCAGGTTTTCCGACT ATTCCGCTGTCTCGTCTGTTTGATAATGCTATGCTGCGTGCGCA CCGTCTGCACCAGCTGGCTTTGATACTTACCAGGAATTTGAAG AAGCTACATTCCTAAAGAGCAGAATGTACTCTTTCCTGCAAAAC CCAACAGAGTTCTCTCTGCTTCAGCGAATCTATTCCGACGCCTTC CAATCGCGAGGAAACTCAGCAAAAGTCCAATCTGGAACTACTC CGCATTTCTCTGCTTCTGATTCAGAGCTGGCTAGAACCAGTGCA ATTTCTGCGTTCCGTCTTCGCCAATAGCCTAGTTTATGGCGCAT | 786 |

TABLE 36-continued

Exemplary GHXTEN comprising growth hormones and two XTEN sequences

| GHXTEN Name* | Amino Acid Sequence | SEQ ID NO: | DNA Nucleotide Sequence | SEQ ID NO: |
|---|---|---|---|---|
| | CFRKDMDKVETFLRI VQCRSVEGSCGFGG TSESATPESGPGSEP ATSGSETPGTSESAT PESGPGSEPATSGSE TPGTSESATPESGPG TSTEPSEGSAPGSPA GSPTSTEEGTSESATP ESGPGSEPATSGSET PGTSESATPESGPGSP AGSPTSTEEGSPAGS PTSTEEGTSTEPSEGS APGTSESATPESGPG TSESATPESGPGTSES ATPESGPGSEPATSG SETPGSEPATSGSETP GSPAGSPTSTEEGTS TEPSEGSAPGTSTEPS EGSAPGSEPATSGSE TPGTSESATPESGPG TSTEPSEGSAP | | CCGACAGCAACGTATACGATCTCCTGAAAGATCTCGAGGAAGG CATTCAGACCCTGATGGGTCGTTCTCGAGGATGGCTCTCCGCGTA CTGGTCAGATCTTCAAGCAGACTTACTCTAAATTTGATACTAAC AGCCACAATGACGATGCGCTTCTAAAAAACTATGGTCTGCTGT ATTGTTTTCGTAAAGATATGGACAAAGTTGAAACCTTCCTGCGT ATTGTTCAGTGTCGTTCCGTTGAGGGCAGCTGTGGTTTCTAAGG TGGTACCTCTGAAAGCGCAACTCCTGAGTCTGGCCCAGGTAGC GAACCTGCTACCTCCGGCTCTGAGACTCCAGGTACCTCTGAAAG CGCAACCCCGGAATCTGGTCAGGTAGCGAACCTGCAACCTCT GGCTCTGAAACCCCAGGTACCTCTGAAAGCGCTACTCCTGAATC TGGCCCAGGTACTTCTACTGAACGTCCGAGGGCAGCGCACCA GGTAGCCCTGCTGGCTCTCCAACCTCCACCGAAGAAGGTACCTC TGAAAGCGCAACCCCTGAATCCGGCCCAGGTAGCGAACCGGCA ACCTCCGGTTCTGAAACCCCAGGTACTTCTGAAAGCGCTACTCC TGAGTCCGGCCCAGGTAGCCCGGCTGGCTCTCCGACTTCCACCG AGGAAGGTAGCCCCGGCTGGCTCTCCAACTTCTACTGAAGAAGG TACTTCTACCGAACCTTCCGAGGGCAGCGCACCAGGTACTTCT AAAGCGCTACCCCTGAGTCCGGCCCAGGTACTTCTGAAAGCGC TACTCCTGAATCCGGTCCAGGTACTTCTGAAAGCGCTACCCCGG AATCTGGCCCAGGTAGCGAACCGGCTACTTCTGGTTCTGAAACC CCAGGTAGCGAACCGGCTACCTCCGGTTCTGAAACTCCAGGTA GCCCAGCAGGCTCTCCGACTTCCACTGAGGAAGGTACTTCTACT GAACCTTCCGAAGGCAGCGCACCAGGTACCTCTACTGAACCTT CTGAGGGCAGCGCTCCAGGTAGCGAACCTGCAACCTCTGGCTC TGAAACCCCAGGTACCTCTGAAAGCGCTACTCCTGAATCTGGCC CAGGTACTTCTACTGAACCGTCCGAGGGCAGCGCACCA | |
| AG864- hGH- AE288 | GASPGTSSTGSPGSS PSASTGTGPGSSPSA STGTGPGTPGSGTAS SSPGSSTPSGATGSP GSNPSASTGTGPGAS PGTSSTGSPGTPGSG TASSSPGSSTPSGAT GSPGTPGSGTASSSP GASPGTSSTGSPGAS PGTSSTGSPGTPGSG TASSSPGSSTPSGAT GSPGASPGTSSTGSP GTPGSGTASSSPGSS TPSGATGSPGSNPSA STGTGPGSSPSASTG TGPGSSTPSGATGSP GSSTPSGATGSPGAS PGTSSTGSPGASPGT SSTGSPGASPGTSST GSPGTPGSGTASSSP GASPGTSSTGSPGAS PGTSSTGSPGASPGT SSTGSPGSSPSASTGT GPGTPGSGTASSSPG ASPGTSSTGSPGASP GTSSTGSPGASPGTS STGSPGSSTPSGATG SPGSSTPSGATGSPG ASPGTSSTGSPGTPG SGTASSSPGSSTPSG ATGSPGSSTPSGATG SPGSSTPSGATGSPG SSPSASTGTGPGASP GTSSTGSPGASPGTS STGSPGTPGSGTASS SPGASPGTSSTGSPG ASPGTSSTGSPGTPG SGTASSSPGSSTPSG ATGSPGSSTPSGATG SPGSSTPSGATGSPG TPGSGTASSSPGSSTP SGATGSPGTPGSGTA SSSPGSSTPSGATGSP GSSTPSGATGSPGSS PSASTGTGPGSSPSA STGTGPGASPGTSST GSPGTPGSGTASSSP | 787 | GGTGCTTCCCCGGGCACCAGCTCTACTGGTTCTCCAGGTTCTAG CCCGTCTGCTTCTACTGGTACTGGTCCAGGTTCTAGCCCTTCTGC TTCCACTGGTACTGGTCCAGGTACCCCGGGTAGCGGTACCGCTT CTTCTTCTCCAGGTAGCTCTACTCCGTCTGGTGCTACCGGCTCTC CAGGTTCTAACCCTTCTGCATCCACCGGTACCGGCCCAGGTGCT TCTCCGGGCACCAGCTCTACTGGTTCTCCAGGTACCCCGGGCAG CGGTACCGCATCTTCTTCTCCAGGTAGCTCTACTCCTTCTGGTGC AACTGGTTCTCCAGGTACTCCTGGCAGCGGTACCGCTTCTTCTT CTCCAGGTGCTTCTCCGGGTACTAGCTCTACTGGTTCTCCAGGT GCTTCTCCGGGCACTAGCTCTACTGGTTCTCCAGGTACCCCGGG TAGCGGTACTGCTTCTTCCTCTCCAGGTAGCTCTACCCCTTCTGG TGCAACCGGCTCTCCAGGTGCTTCTCCGGGCACCAGCTCTACCG GTACCCCAGGTACCCCGGGTAGCGGTACCGCTTCTTCTTCTCCA GGTAGCTCTACTCCGTCTGGTGCTACCGGCTCTCCAGGTTCTAA CCCTTCTGCATCCACCGGTACCGGCCCAGGTTCTAGCCCTTCTG CTTCCACCGGTACTGGCCCAGGTAGCTCTACCCCTTCTGGTGCT ACCGGCTCCCCAGGTAGCTCTACTGGTACTGGTCCAGGTAGCTC TCCAGGTGCATCTCCGGGCACTAGCTCTACTGGTTCTCCAGGTG CATCCCCTGGCACTAGCTCTACTGGTTCTCCAGGTGCTTCTCCT GGTACCAGCTCTACTGGTTCTCCAGGTACTCCTGGCAGCGGTAC CGCTTCTTCTCCAGGTGCTTCTCCGGGCACTAGCTCTACTGGTTC TCCAGGTGCTTCTCCGGGCACTAGCTCTACTGGTTCTCCAG GTGCTTCCCCGGGCACTAGCTCTACCGGTTCTCCAGGTTCTAGC CCTTCTGCATCTACTGGTACTGGCCCAGGTTCTAGCCCTTCTG CTTCCACCGGTACTGGCCCAGGTAGCTCTACCCCTTCTGGTGCT ACCGGCTCCCCAGGTGCATCTCCGGGCACTAGCTCTACTGGTTC TCCAGGTGCATCTCCGGGCACTAGCTCTACTGGTTCTCCAGGTA GCTCTACTGGTACCAGCTCTACTGGTTCTCCAGGTAGCTCTACT CCGTCTGGTGCAACCGGTTCCCCAGGTAGCTCTACTCCTTCTGGTGCTACTGGTTCCCCAGGTAGCTCT ACTCCGTCTGGTGCAACCGGCTCCCCAGGTTCTAGCCCGTCTGC TTCCACTGGTACTGGCCCAGGTTCTCCCGGGCACCAGCTCTACC GGTTCTCCAGGTGCATCCCCGGGTACCAGCTCTACCGGTTCT CCAGGTACTCCTGGCAGCGGTACTGCATCTTCCTCTCCAGGTGC TTCTCCGGGCACCAGCTCTACTGGTTCTCCAGGTGCATCTCCGG GCACTAGCTCTACTGGTTCTCCAGGTGCATCCCCTGGCACTAGC TCTACTGGTTCTCCAGGTGCTTCTCCTGGTACCAGCTCTACTGGT TCTCCAGGTACCCCTGGTAGCGGTACTGCTTCTTCCTCTCCAGG TAGCTCTACTCCGTCTGGTGCTACCGGTTCTCCAGGTACCCCGG GTAGCGGTACCGCTTCTTCCTCTCCAGGTAGCTCTACCCCTTC TTCCTCTCCAGGTAGCTCTACCCCTTCTGGTGCTACTGGCTCTCC AGGTAGCTCTACCCCGTCTGGTGCTACTGGCTCCCCAGGTTCTA GCCCTTCTGCATCCACCGGTACCGGTCCAGGTTCTAGCCCGTCT GCATCTACTGGTACTGGTCCAGGTGCATCCCCGGGCACTAGCTC | 788 |

TABLE 36-continued

Exemplary GHXTEN comprising growth hormones and two XTEN sequences

| GHXTEN Name* | Amino Acid Sequence | SEQ ID NO: | DNA Nucleotide Sequence | SEQ ID NO: |
|---|---|---|---|---|
| | GSSTPSGATGSPGSS PSASTGTPGPGSSPSA STGTGPGASPGTSST GSPGASPGTSSTGSP GSSTPSGATGSPGSS PSASTGTGPGASPGT SSTGSPGSSPSASTGT GPGTPGSGTASSSPG SSTPSGATGSPGSSTP SGATGSPGASPGTSS TGSPGFPTIPLSRLFD NAMLRAHRLHQLAF DTYQEFEEAYIPKEQ KYSFLQNPQTSLCFS ESIPTPSNREETQQKS NLELLRISLLLIQSWL EPVQFLRSVFANSLV YGASDSNVYDLLKD LEEGIQTLMGRLEDG SPRTGQIFKQTYSKF DTNSHNDDALLKNY GLLYCFRKDMDKVE TFLRIVQCRSVEGSC GFGGTSESATPESGP GSEPATSGSETPGTS ESATPESGPGSEPAT SGSETPGTSESATPES GPGTSTEPSEGSAPG SPAGSPTSTEEGTSES ATPESGPGSEPATSG SETPGTSESATPESGP GSPAGSPTSTEEGSP AGSPTSTEEGTSTEPS EGSAPGTSESATPES GPGTSESATPESGPG TSESATPESGPGSEP ATSGSETPGSEPATS GSETPGSPAGSPTST EEGTSTEPSEGSAPG TSTEPSEGSAPGSEP ATSGSETPGTSESAT PESGPGTSTEPSEGS AP | | TACCGGTTCTCCAGGTACTCCTGGTAGCGGTACTGCTTCTTCTTC TCCAGGTAGCTCTACTCCTTCTGGTGCTACTGGTTCTCCAGGTTC TAGCCCTTCTGCATCCACCGGTACCGGCCCAGGTTCTAGCCCGT CTGCTTCTACCGGTACTGGTCCAGGTGCTTCTCCGGGTACTAGC TCTACTGGTTCTCCAGGTGCATCTCCTGGTACTAGCTCTACTGG TTCTCCAGGTAGCTCTACTCCGTCTGGTGCAACCGGCTCTCCAG GTTCTAGCCCTTCTGCATCTACCGGTACTGGTCCAGGTGCATCC CCTGGTACCAGCTCTACCGGTTCTCCAGGTTCTAGCCCTTCTGC TTCTACCGGTACCGGTCCAGGTACCCCTGGCAGCGGTACCGCAT CTTCCTCTCCAGGTAGCTCTACTCCGTCTGGTGCAACCGGTTCC CCAGGTAGCTCTACTCCTTCTGGTGCTACTGGCTCCCCAGGTGC ATCCCCTGGCACCAGCTCTACCGGTTCTCCAGGTTTTCCGACTA TTCCGCTGTCTCGTCTGTTTGATAATGCTATGCTGCGTGCGCAC CGTCTGCACCAGCTGGCCTTTGATACTTACCAGGAATTTGAAGA AGCcTACATTCCTAAAGAGCAGAAGTACTCTTTCCTGCAAAACC CACAGACTTCTCTGCTTCAGCGAATCTATTCCGACGCCTTCC AATCGCGAGGAAACTCAGCAAAGTCCAATCTGGAACTACTCC GCATTTCTCTGCTTCTGATTCAGAGCTGGCTAGAACCAGTGCAA TTTCTGCGTTCCGTCTTCGCCAATAGCCTAGTTTATGGCGCATCC GACAGCAACGTATACGATCTCCTGAAAGATCTCGAGGAAGGCA TTCAGACCCTGATGGGTCGTCTCGAGGATGGCTCTCCGCGTACT GGTCAGATCTTCAAGCAGACTTACTCTAAATTTGATACTAACAG CCACAATGACGATGCGCTTCTAAAAAACTATGGTCTGCTGTATT GTTTTCGTAAAGATATGGACAAAGTTGAAACCTTCCTGCGTATT GTTCAGTGTCGTTCCGTTGAGGGCAGCTGTGGTTTCTAAGGTGG TACCTCTGAAAGCGCAACTCCTGAGTCTGGCCCAGGTAGCGAA CCTGCTACCTCCGGCTCTGAGCTCCAGGTACCTCTGAAAGCGC AACCCCGGAATCTGGTCCAGGTAGCGAACCTGCAACCTCTGGC TCTGAAACCCAGGTACCTCTGAAAGCGCTACTCCTGAATCTGG CCCAGGTACTTCTACTGAACCGTCCGAGGGCAGCGCACCAGGT AGCCCTGCTGGCTCTCCAACCTCCACCGAAGAAGGTACCTCTGA AAGCCAACCCTGAATCCGGCCCAGGTAGCGAACCGGCAACC TCCGGTTCTGAAACCCAGGTACTTCTGAAAGCGCTACTCCTGA GTCCGGCCCAGGTAGCCCGGCTGGCTCTCCGACTTCCACCGAG GAAGGTAGCCCGGCTGGCTCTCCAACTTCTACTGAAGAAGGTA CTTCTACCGAACCTTCCGAGGGCAGCGCACCAGGTACTTCTGAA AGCGCTACCCCTGAGTCCGGCCCAGGTACTTCTGAAAGCGCTA CTCCTGAATCCGGTCCAGGTACTTCTGAAAGCGCTACCCCGGAA TCTGGCCCAGGTAGCGAACCGGCTACTTCTGGTTCTGAAACCCC AGGTAGCGAACCGTCCGAGGGCTCCAGGTACTCCAGGTAGC CCAGCAGGCTCTCCGACTTCCACTGAGGAAGGTACTTCTACTGA ACCTTCCGAAGGCAGCGCACCAGGTACCTCTACTGAACCTTCTG AGGGCAGCGCTCCAGGTAGCGAACCTGCAACCTCTGGCTCTGA AACCCCAGGTACCTCTGAAAGCGCTACTCCTGAATCTGGCCCA GGTACTTCTACTGAACCGTCCGAGGGCAGCGCACCA | |
| AM875- hGH- AE288 | GTSTEPSEGSAPGSE PATSGSETPGSPAGS PTSTEEGTSSTAESP GPGTSTPESGSASPG STSESPSGTAPGSTSE SPSGTAPGTSTPESGS ASPGTSTPESGSASP GSEPATSGSETPGTS ESATPESGPGSPAGS PTSTEEGTSTEPSEGS APGTSESATPESGPG TSTEPSEGSAPGTSTE PSEGSAPGSPAGSPT STEEGTSTEPSEGSAP GTSTEPSEGSAPGTS ESATPESGPGTSESA TPESGPGTSTEPSEGS APGTSTEPSEGSAPG TSESATPESGPGTSTE PSEGSAPGSEPATSG SETPGSPAGSPTSTEE GSSTPSGATGSPGTP GSGTASSSPGSSTPS GATGSPGTSTEPSEG SAPGTSTEPSEGSAP GSEPATSGSETPGSP AGSPTSTEEGSPAGS PTSTEEGTSTEPSEGS | 789 | GGTACTTCTACTGAACCGTCTGAAGGCAGCGCACCAGGTAGCG AACCGGCTACTTCTGGTTCTGAAACCCCAGGTAGCCCTGCAGGC TTTCTCCAACTTCTACTGAAGAAGGTTCTACCAGCTCTACCGCAG AATCTCCTGGTCAGGTACCTCTACTCCGGAAAGCGGCTCTGCA TCTCCAGGTTCTACTAGCGAATCTCCTTCTGGCACTGCACCAGG TTCTACTAGCGAATCCCGTCTGGTACTGCTCCAGGTACTTCTA CTCCTGAAAGCGGTTCCGCTTCTCCAGGTACCTCTACTCCGGAA AGCGGTTCTGCATCTCCAGGTAGCGAACCGGCAACCTCCGGCT CTGAAACCCCAGGTACCTCTGAAAGCGCTACTCCTGAATCCGG CCCAGGTAGCCCGGCAGGTTCTCCGACTTCCACTGAGGAAGGT ACCTCTACTGAACCTTCTGAGGGCAGCGCTCCAGGTACTTCTGA AGCGCTACCCCGGAGTCCGGTCCAGGTACTTCTACTGAACCGT CCGAAGGTAGCGCACCAGGTACTTCTACCGAACCGTCCGAGGG TAGCGCACCAGGTAGCCCAGCAGGTTCTCCTACCTCCACCGAG GAAGGTACTTCTACTGAACCTTCTGAGGGCAGCGCACCAGGTA CTTCTACCGAACCTTCCGAGGGCAGCGCACCAGGTACTTCTGAA AGCGCTACCCCTGAGTCCGGCCCAGGTACTTCTGAAAGCGCTA CCTGAATCCGGTCCAGGTACCTCTACTGAACCTTCCGAAGGC AGCGCTCCAGGTACCTCTACTGAACCGTCCGAGGGCAGCGCAC CAGGTACTTCTGAAAGCGCAACCCCTGAATCCGGTCCAGGTAC TTCTACTGAACCTTCCGAAGGTAGCGCTCCAGGTAGCGAACCTG CTACTTCTGGTTCTGAAACCCCAGGTAGCCCGGCTGGCTCTCCG ACCTCCACCGAGGAAGGTAGCTCTACTCCGTCTGGTGCTACTGG TTCTCCAGGTACTCCGGGCAGCGGTACTGCTTCTTCCTCTCCAG GTAGCTCTACCCCTTCTGGTGCTACTGGCTCTCCAGGTACTTCT ACCGAACCGTCCGAGGGTAGCGCTCCAGGTACCTCTACTGAAC CGTCTGAGGGTAGCGCTCCAGGTAGCGAACCGGCAACCTCCGG CTCTGAAACTCCAGGTAGCCCTGCTGGCTCTCCGACTTCTACTG | 790 |

TABLE 36-continued

Exemplary GHXTEN comprising growth hormones and two XTEN sequences

| GHXTEN Name* | Amino Acid Sequence | SEQ ID NO: | DNA Nucleotide Sequence | SEQ ID NO: |
|---|---|---|---|---|
| | APGASASGAPSTGGT SESATPESGPGSPAG SPTSTEEGSPAGSPTS TEEGSTSSTAESPGP GSTSESPSGTAPGTSP SGESSTAPGTPGSGT ASSSPGSSTPSGATG SPGSSPSASTGTGPG SEPATSGSETPGTSES ATPESGPGSEPATSG SETPGSTSSTAESPGP GSTSSTAESPGPGTSP SGESSTAPGSEPATS GSETPGSEPATSGSE TPGTSTEPSEGSAPG STSSTAESPGPGTSTP ESGSASPGSTSESPSG TAPGTSTEPSEGSAP GTSTEPSEGSAPGTS TEPSEGSAPGSSTPSG ATGSPGSSPSASTGT GPGASPGTSSTGSPG SEPATSGSETPGTSES ATPESGPGSPAGSPT STEEGSSTPSGATGS PGSSPSASTGTGPGA SPGTSSTGSPGTSESA TPESGPGTSTEPSEGS APGTSTEPSEGSAPG FPTIPLSRLFDNAML RAHRLHQLAFDTYQ EFEEAYIPKEQKYSF LQNPQTSLCFSESIPT PSNREETQQKSNLEL LRISLLLIQSWLEPVQ FLRSVFANSLVYGAS DSNVYDLLKDLEEGI QTLMGRLEDGSPRT GQIFKQTYSKFDTNS HNDDALLKNYGLLY CFRKDMDKVETFLRI VQCRSVEGSCGFGG TSESATPESGPGSEP ATSGSETPGTSESAT PESGPGSEPATSGSE TPGTSESATPESGPG TSTEPSEGSAPGSPA GSPTSTEEGTSESATP ESGPGSEPATSGSET PGTSESATPESGPGSP AGSPTSTEEGSPAGS PTSTEEGTSTEPSEGS APGTSESATPESGPG TSESATPESGPGTSES ATPESGPGSEPATSG SETPGSEPATSGSETP GSPAGSPTSTEEGTS TEPSEGSAPGTSTEPS EGSAPGSEPATSGSE TPGTSESATPESGPG TSTEPSEGSAP | | AGGAAGGTAGCCCGGCTGGTTCTCCGACTTCTACTGAGGAAGG TACTTCTACCGAACCTTCCGAAGGTAGCGCTCCAGGTGCAAGC GCAAGCGGCGCGCCAAGCACGGAGGTACTTCTGAAAGCGCTA CTCCTGAGTCCGGCCCAGGTAGCCCGGCTGGCTCTCCGACTTCC ACCGAGGAAGGTAGCCCGGCTGGCTCTCCAACTTCTACTGAAG AAGGTTCTACCAGCTCTACCGCTGAATCTCCTGGCCCAGGTTCT ACTAGCGAATCTCCGTCTGGCACCGCACCAGGTACTTCCCCTAG CGGTGAATCTTCTACTGCACCAGGTACCCCTGGCAGCGGTACCG CTTCTTCCTCTCCAGGTAGCTCTACCCCGTCTGGTGCTACTGGCT CTCCAGGTTCTAGCCCGTCTGCATCTACCGGTACCGGCCCAGGT AGCGAACCGGCACCTCCGGCTCTGAAACTCCAGGTACTTCTG AAAGCGCTACTCCGGAATCCGGCCCAGGTAGCGAACCGGCTAC TTCCGGCTCTGAAACCCCAGGTTCCACCAGCTCTACTGCAGAAT CTCCGGGCCCAGGTTCTACTAGCTCTACTGCAGAATCTCCGGGT CCAGGTACTTCTCCTAGCGGCGAATCTTCTACCGCTCCAGGTAG CGAACCGGCAACCTCTGGCTCTGAAACTCCAGGTAGCGAACCT GCAACCTCCGGCTCTGAAACCCCAGGTACTTCTACTGAACCTTC TGAGGGCAGCGCACCAGGTTCTACCAGCTCTACCGCAGAATCT CCTGGTCCAGGTACCTCTACTCCGGAAAGCGGCTCTGCATCTCC AGGTTCTACTAGCGAATCTCCTTCTGGCACTGCACCAGGTACTT CTACCGAACCGTCCGAAGGCAGCGCTCCAGGTACCTCTACTGA ACCTTCCGAGGGCAGCGCTCCAGGTACCTCTACCGAACCTTCTG AAGGTAGCGCACCAGGTAGCTCTACTCCGTCTGGTGCAACCGG CTCCCCCAGGTTCTAGCCCGTCTGCTTCCACTGGTACTGGCCCAG GTGCTTCCCCGGGCACCAGCTCTACTGGTTCTCCAGGTAGCGAA CCTGCTACCTCCGGTTCTGAAACCCAGGTACCTCTGAAAGCGC AACTCCGGAGTCTGGCCCAGGTAGCGAACCTGCTACCTCCGGCT CTGAGACCCACTGAGGAAGGTAGCTCTACTCCGTCTGGTGCAACCGGCTCC CCAGGTTCTAGCCCGTCTGCTTCCACTGGTACTGGCCCAGGTGC TTCCCCGGGCACCAGCTCTACTGGTTCTCCAGGTACCTCTGAAA GCGCTACTCCGGAGTCTGGCCCAGGTACCTCTACTGAACCTGCT GAGGGTAGCGCTCCAGGTACTTCTGAAAGCGCTCCAGGTACTTG GAGGGTAGCGCTCCAGGTACTTCTACTGAACCGTCCGAAGGTA GAGGGCAGCGCACCAGGTTTTCCGACTATTCCGCTGTCTCGTCTGTTTGAT AATGCTATGCTGCGTGCGCACCGTCTGCACCAGCTGGCCTTTGA TACTTACCAGGAATTTGAAGAAGCcTACATTCCTAAAGAGCAGA AGTACTCTTTCCTGCAAACCCACAGACTTCTCTCTGCTTCAGA GAATCTATTCCGACGCCTTCCAATGCGAGGAAACTCAGCAAA AGTCCAATCTGGAACTACTCCGCATTTCTCTGCTTCTGATTCAG AGCTGGCTAGAACCAGTGCAATTTCTGCGTTCCGTCTTCGCCAA TAGCCTAGTTTATGCGCATCCGACAGCAACGTATACGATCTCC TGAAAGATCTCGAGGAAGGCATTCAGACCCTGATGGGTCGTCT CGAGGATGGCTCTCCGCGTACTGGTCAGATCTTCAAGCAGACTT ACTCTAAATTTGATACTAACAGCCACAATGACGATGCGCTTCTA AAAAACTATGGTCTGTTATTGTTTTCGTAAAGATATGGACAA AGTTGAAACCTTCCTGCGTATTGTTCAGTGTCGTTCCGTTGAGG GCAGCTGTGGTTTCTAAGGTGGTACCTCTGAAAGCGCAACTCCT GAGTCTGGCCCAGGTAGCGAACCTGCTACCTCCGGCTCTGAGA CTCCAGGTACCTCTGAAAGCGCTACCCCGGAATCTGGTCCAGG TAGCGAACCTGCAACCTCTGGCTCTGAAACCCCAGGTACCTCTG AAAGCGCTACTCCTGAATCTGGCCCAGGTACTTCTACTGAACCG TCCGAGGGCAGCGCACCAGGTAGCCCTGCTGGCTCTCCAACCT CCACCGAAGAAGGTACCAGCGCAACCCCTGAATCCGG CCCAGGTAGCGAACCGGCAACCTCCGGTTCTGAAACCCCAGGT ACTTCTGAAAGCGCTACTCCTGAGTCCGGCCCAGGTAGCCCCGG CTGGCTCTCCGACTTCCACCGAGGAAGGTAGCCCGGCTGGCTCT CCAACTTCTACTGAAGAAGGTACTTCTACCGAACCTTCCGAGGG CAGCGCACCAGGTTCTACCAGCTCTACCGCAGAATCTCCTGGT CCAGGTACTTCTGAAAGCGCTACTCCTGAATCCGGTCCAGGTAC TTCTGAAAGCGCTACCCCGGAATCTGGCCCAGGTAGCGAACCG GCTACTTCTGGTTCTGAAACCCCAGGTAGCGAACCGGCTACCTC CGGTTCTGAAACTCCAGGTAGCCAGCAGGCTCTCCGACTTCCA CTGAGGAAGGTACTTCTACTGAACCTTCCGAAGGCAGCGCACC AGGTACCTCTACTGAACCTTCTGAGGGCAGCGCTCCAGGTAGC GAACCTGCAACCTCTGGCTCTGAAACCCCAGGTACCTCTGAAA GCGCTACTCCTGAATCTGGCCCAGGTACTTCTACTGAACCGTCC GAGGGCAGCGCACCA | |
| AE912-hGH-AE288 | MAEPAGSPTSTEEGT PGSGTASSSPGSSTPS GATGSPGASPGTSST GSPGSPAGSPTSTEE GTSESATPESGPGTS TEPSEGSAPGSPAGS PTSTEEGTSTEPSEGS | 791 | ATGGCTGAACCTGCTGGCTCTCCAACCTCCACTGAGGAAGGTA CCCCGGGTAGCGGTACTGCTTCTTCCTCTCCAGGTAGCTCTACC CCTTCTGGTGCAACCGGTTCTCCAGGTGCTTCTCCGGGCACCAG CTACCGGTTCTCCAGGTAGCCCGGCTGGCTCTCCTACCTCTA CTGAGGAAGGTACTTCTGAAAGCGCTACTCCTGAGTCTGGTCCA GGTACCTCTGAAACCGTCCGAAGGTAGCGCTCCAGGTAGCC CAGCAGGCTCTCCGACTTCCACTGAGGAAGGTACTTCTACTGAA | 792 |

TABLE 36-continued

Exemplary GHXTEN comprising growth hormones and two XTEN sequences

| GHXTEN Name* | Amino Acid Sequence | SEQ ID NO: | DNA Nucleotide Sequence | SEQ ID NO: |
|---|---|---|---|---|
| | APGTSTEPSEGSAPG | | CCTTCCGAAGGCAGCGCACCAGGTACCTCTACTGAACCTTCTGA | |
| | TSESATPESGPGSEP | | GGGCAGCGCTCCAGGTACTTCTGAAAGCGCTACCCCGGAATCT | |
| | ATSGSETPGSEPATS | | GGCCCAGGTAGCGAACCGGCTACTTCTGGTTCTGAAACCCCAG | |
| | GSETPGSPAGSPTST | | GTAGCGAACCGGCTACCTCCGGTTCTGAAACTCCAGGTAGCCC | |
| | EEGTSESATPESGPG | | GGCAGGCTCTCCGACCTCTACTGAGGAAGGTACTTCTGAAAGC | |
| | TSTEPSEGSAPGTSTE | | GCAACCCCGGAGTCCGGCCCAGGTACCTCTACCGAACCGTCTG | |
| | PSEGSAPGSPAGSPT | | AGGGCAGCGCACCAGGTACTTCTACCGAACCGTCCGAGGGTAG | |
| | STEEGTSTEPSEGSAP | | CGCACCAGGTAGCCCAGCAGGTTCTCCTACCTCCACCGAGGAA | |
| | GTSTEPSEGSAPGTS | | GGTACTTCTACCGAACCGTCCGAGGGTAGCGCACCAGGTACCT | |
| | ESATPESGPGTSTEPS | | CTACTGAACCTTCTGAGGGCAGCGCTCCAGGTACTTCTGAAAGC | |
| | EGSAPGTSESATPES | | GCTACCCCGGAGTCGGTCCAGGTACTTCTACTGAACCGTCCGA | |
| | GPGSEPATSGSETPG | | AGGTAGCGCACCAGGTACTTCTGAAAGCGCAACCCCTGAATCC | |
| | TSTEPSEGSAPGTSTE | | GGTCCAGGTAGCGAACCGGCTACTTCTGGCTCTGAGACTCCAG | |
| | PSEGSAPGTSESATP | | GTACTTCTACCGAACCGTCCGAAGGTAGCGCACCAGGTACTTCT | |
| | ESGPGTSESATPESG | | ACTGAACCGTCTGAAGGTAGCGCACCAGGTACTTCTGAAAGCG | |
| | PGSPAGSPTSTEEGT | | CAACCCCGGAATCCGGCCCAGGTACCTCTGAAAGCGCAACCCC | |
| | SESATPESGPGSEPA | | GGAGTCCGGCCCAGGTAGCCCTGCTGGCTCTCCAACCTCCACCG | |
| | TSGSETPGTSESATPE | | AAGAAGGTACCTCTGAAAGCGCAACCCCTGAATCCGGCCCAGG | |
| | SGPGTSTEPSEGSAP | | TAGCGAACCGGCAACCTCCGGTTCTGAAACCCCAGGTACCTCT | |
| | GTSTEPSEGSAPGTS | | GAAAGCGCTACTCCGGAGTCTGGCCCAGGTACCTCTACTGAAC | |
| | TEPSEGSAPGTSTEPS | | CGTCTGAGGGTAGCGCTCCAGGTACTTCTACTGAACCGTCCGAA | |
| | EGSAPGTSTEPSEGS | | GGTAGCGCACCAGGTACTTCTACCGAACCGTCCGAAGGCAGCG | |
| | APGTSTEPSEGSAPG | | CTCCAGGTACCTCTACTGAACCTTCCGAGGGCAGCGCTCCAGGT | |
| | SPAGSPTSTEEGTSTE | | ACCTCTACCGAACCTTCTGAAGGTAGCGCACCAGGTACTTCTAC | |
| | PSEGSAPGTSESATP | | CGAACCGTCCGAGGGTAGCGCACCAGGTAGCCCAGCAGGTTCT | |
| | ESGPGSEPATSGSET | | CCTACCTCCACCGAGGAAGGTACTTCTACCGAACCGTCCGAGG | |
| | PGTSESATPESGPGS | | GTAGCGCACCAGGTACTCTGAAAGCGCAACTCCTGAGTCTGG | |
| | EPATSGSETPGTSES | | CCCAGGTAGCGAACCTGCTACCTCCGGCTCTGAGACTCCAGGT | |
| | ATPESGPGTSTEPSE | | ACCTCTGAAAGCGCAACCCCGGAATCTGGTCCAGGTAGCGAAC | |
| | GSAPGTSESATPESG | | CTGCAACCTCTGGCTCTGAAACCCCAGGTACCTCTGAAAGCGCT | |
| | PGSPAGSPTSTEEGSP | | ACTCCTGAATCTGGCCCAGGTACTTCTACTGAACCGTCCGAGGG | |
| | AGSPTSTEEGSPAGS | | CAGCGCACCAGGTACTTCTGAAAGCGCTACTCCTGAGTCCGAC | |
| | PTSTEEGTSESATPES | | CCAGGTAGCCCGGCTGGCTCTCCGACTTCCACCGAGGAAGGTA | |
| | GPGTSTEPSEGSAPG | | GCCCGGCTGGCTCTCCAACTTCTACTGAAGAAGGTAGCCCGGC | |
| | TSESATPESGPGSEP | | AGGCTCTCCGACCTCTACTGAGGAAGGTACTTCTGAAAGCGCA | |
| | ATSGSETPGTSESAT | | ACCCCGGAGTCCGGCCCAGGTACCTCTACCGAACCGTCTGAGG | |
| | PESGPGSEPATSGSE | | GCAGCGCACCAGGTACCTCTGAAAGCGCAACCTCCTGAGTCTGG | |
| | TPGTSESATPESGPG | | CCCAGGTAGCGAACCTGCTACCTCCGGCTCTGAGACTCCAGGT | |
| | TSTEPSEGSAPGSPA | | ACCTCTGAAAGCGCAACCCCGGAATCTGGTCCAGGTAGCGAAC | |
| | GSPTSTEEGTSESATP | | CTGCAACCTCTGGCTCTGAAACCCCAGGTACCTCTGAAAGCGCT | |
| | ESGPGSEPATSGSET | | ACTCCTGAATCTGGCCCAGGTACTTCTACTGAACCGTCCGAGGG | |
| | PGTSESATPESGPGSP | | CAGCGCACCAGGTAGCCCTGCTGGCTCTCCAACCTCCACCGAA | |
| | AGSPTSTEEGSPAGS | | GAAGGTACCTCTGAAAGCGCAACCCCTGAATCCGGCCCAGGTA | |
| | PTSTEEGTSTEPSEGS | | GCGAACCGGCAACCTCCGGTTCTGAAACCCCAGGTACTTCTGA | |
| | APGTSESATPESGPG | | AAGCGCTACTCCTGAGTCCGGCCCAGGTAGCCCGGCTGGCTCTC | |
| | TSESATPESGPGTSES | | CGACTTCCACCGAGGAAGGTAGCCCGGCTGGCTCTCCAACTTCT | |
| | ATPESGPGSEPATSG | | ACTGAAGAAGGTACTTCTACCGAACCTTCCGAGGGCAGCGCAC | |
| | SETPGSEPATSGSETP | | CAGGTACTTCTGAAAGCGCTACCCCTGAGTCCGGCCCAGGTACT | |
| | GSPAGSPTSTEEGTS | | TCTGAAAGCGCTACTCCTGAATCCGGTCCAGGTACTTCTGAAAG | |
| | TEPSEGSAPGTSTEPS | | CGCTACCCCGGAATCTGGCCCAGGTAGCGAACCGGCTACTTCT | |
| | EGSAPGSEPATSGSE | | GGTTCTGAAACCCCAGGTAGCGAACCGGCTACCTCCGGTTCTG | |
| | TPGTSESATPESGPG | | AAACTCCAGGTAGCCCAGGCTCTCCGACTTCCACTGAGGAAG | |
| | TSTEPSEGSAPGFPTI | | AGGTACTTCTACTGAACCTTCCGAAGGCAGCGCACCAGGTACC | |
| | PLSRLFDNAMLRAH | | TCTACTGAACCTTCTGAGGGCAGCGCTCCAGGTAGCGAACCTG | |
| | RLHQLAFDTYQEFEE | | CAACCTCTGGCTCTGAAACCCCAGGTACCTCTGAAAGCGCTACT | |
| | AYIPKEQKYSFLQNP | | CCTGAATCTGGCCCAGGTACTTCTACTGAACCGTCCGAGGGCA | |
| | QTSLCFSESIPTPSNR | | GCGCACCAGGTTTTCCGACTATTCCGTCTCGTCTGTTTGAT | |
| | EETQQKSNLELLRIS | | AATGCTATGCTGCGTGCGCACCGTCTGCACCAGCTGGCCTTTGA | |
| | LLLIQSWLEPVQFLR | | TACTTACCAGGAATTTGAAGAAGCTACATTCCTAAAGAGCAGA | |
| | SVFANSLVYGASDS | | AGTACTCTTTCCTGCAAAACCCACAGACTTCTCTCTGCTTCAGC | |
| | NVYDLLKDLEEGIQT | | GAATCTATTCCGACGCCTTCCAATCGCGAGGAAACTCAGCAAA | |
| | LMGRLEDGSPRTGQI | | AGTCCAATCTGGAACTACTCCGCATTTCTCTGCTTCTGATTCAG | |
| | FKQTYSKFDTNSHN | | AGCTGGCTAGAACCAGTGCAATTTCTGCGTTCCGTCTTCGCCAA | |
| | DDALLKNYGLLYCF | | TAGCCTAGTTTATGGCGCATCCGACAGCAACGTATACGATCTCC | |
| | RKDMDKVETFLRIV | | TGAAAGATCTCGAGGAAGGCATTCAGACCCTGATGGGTCGTCT | |
| | QCRSVEGSCGFGGTS | | CGAGGATGGCTCTCCGCGTACTGGTCAGATCTTCAAGCAGACTT | |
| | ESATPESGPGSEPAT | | ACTCTAAATTTGATACTAACAGCCACAATGACGATGCGCTTCTA | |
| | SGSETPGTSESATPES | | AAAAACTATGGTCTGCTGTATTGTTTTCGTAAAGATATGGACAA | |
| | GPGSEPATSGSETPG | | AGTTGAAACTTTCCTGCGTATTGTTCAGTGTCGTTCCGTTGAGG | |
| | TSESATPESGPGTSTE | | GCAGCTGTGGTTTCTAAGGTGGTACCTCTGAAAGCGCAACTCCT | |
| | PSEGSAPGSPAGSPT | | GAGTCTGGCCCAGGTAGCGAACCTGCTACCTCCGGCTCTGAGA | |
| | STEEGTSESATPESGP | | CTCCAGGTACCTCTGAAAGCGCAACCCCGGAATCTGGTCCAGG | |
| | GSEPATSGSETPGTS | | TAGCGAACCTGCAACCTCTGGCTCTGAAACCCCAGGTACCTCTG | |
| | ESATPESGPGSPAGS | | AAAGCGCTACTCCTGAATCTGGCCCAGGTACTTCTACTGAACCG | |

TABLE 36-continued

Exemplary GHXTEN comprising growth hormones and two XTEN sequences

| GHXTEN Name* | Amino Acid Sequence | SEQ ID NO: | DNA Nucleotide Sequence | SEQ ID NO: |
|---|---|---|---|---|
| | PTSTEEGSPAGSPTST EEGTSTEPSEGSAPG TSESATPESGPGTSES ATPESGPGTSESATP ESGPGSEPATSGSET PGSEPATSGSETPGSP AGSPTSTEEGTSTEPS EGSAPGTSTEPSEGS APGSEPATSGSETPG TSESATPESGPGTSTE PSEGSAP | | TCCGAGGGCAGCGCACCAGGTAGCCCTGCTGGCTCTCCAACCT CCACCGAAGAAGGTACCTCTGAAAGCGCAACCCCTGAATCCGG CCCAGGTAGCGAACCGGCAACCTCCGGTTCTGAAACCCCAGGT ACTTCTGAAAGCGCTACTCCTGAGTCCGGCCCAGGTAGCCCGG CTGGCTCTCCGACTTCCACCGAGGAAGGTAGCCCGGCTGGCTCT CCAACTTCTACTGAAGAAGGTACTTCTACCGAACCTTCCGAGGG CAGCGCACCAGGTACTTCTGAAAGCGCTACCCCTGAGTCCGGC CCAGGTACTTCTGAAAGCGCTACTCCTGAATCCGGTCCAGGTAC TTCTGAAAGCGCTACCCCGGAATCTGGCCCAGGTAGCGAACCG GCTACTTCTGGTTCTGAAACCCCAGGTAGCGAACCGGCTACCTC CGGTTCTGAAACTCCAGGTAGCCCAGCAGGCTCTCCGACTTCCA CTGAGGAAGGTACTTCTACTGAACCTTCCGAAGGCAGCGCACC AGGTACCTCTACTGAACCTTCTGAGGGCAGCGCTCCAGGTAGC GAACCTGCAACCTCTGGCTCTGAAACCCCAGGTACCTCTGAAA GCGCTACTCCTGAATCTGGCCCAGGTACTTCTACTGAACCGTCC GAGGGCAGCGCACCA | |
| AM923- hGH- AE288 | MAEPAGSPTSTEEGA SPGTSSTGSPGSSTPS GATGSPGSSTPSGAT GSPGTSTEPSEGSAP GSEPATSGSETPGSP AGSPTSTEEGSTSST AESPGPGTSTPESGS ASPGSTSESPSGTAP GSTSESPSGTAPGTS TPESGSASPGTSTPES GSASPGSEPATSGSE TPGTSESATPESGPG SPAGSPTSTEEGTSTE PSEGSAPGTSESATP ESGPGTSTEPSEGSA PGTSTEPSEGSAPGSP AGSPTSTEEGTSTEPS EGSAPGTSTEPSEGS APGTSESATPESGPG TSESATPESGPGTSTE PSEGSAPGTSTEPSE GSAPGTSESATPESG PGTSTEPSEGSAPGS EPATSGSETPGSPAG SPTSTEEGSSTPSGAT GSPGTPGSGTASSSP GSSTPSGATGSPGTS TEPSEGSAPGTSTEPS EGSAPGSEPATSGSE TPGSPAGSPTSTEEG SPAGSPTSTEEGTSTE PSEGSAPGASASGAP STGGTSESATPESGP GSPAGSPTSTEEGSP AGSPTSTEEGSTSST AESPGPGTSTESPSGT APGTSPSGESSTAPG TPGSGTASSSPGSSTP SGATGSPGSSPSAST GTGPGSEPATSGSET PGTSESATPESGPGS EPATSGSETPGSTSST AESPGPGSTSSTAESP GPGTSPSGESSTAPG SEPATSGSETPGSEP ATSGSETPGTSTEPSE GSAPGSTSSTAESPG PGTSTPESGSASPGST SESPSGTAPGTSTEPS EGSAPGTSTEPSEGS APGTSTEPSEGSAPG SSTPSGATGSPGSSPS ASTGTGPGASPGTSS TGSPGSEPATSGSET PGTSESATPESGPGSP AGSPTSTEEGSSTPS GATGSPGSSPSASTG | 793 | ATGGCTGAACCTGCTGGCTCTCCAACCTCCACTGAGGAAGGTG CATCCCCGGGCACCAGCTCTACCGGTTCTCCAGGTAGCTCTACC CCGTCTGGTGCTACCGGCTCTCCAGGTAGCTCTACCCCGTCTGG TGCTACTGGCTCTCCAGGTACTTCTACTGAACCGTCTGAAGGCA GCGCACCAGGTAGCGAACCGGCTACTTCCGGTTCTGAAACCCC AGGTAGCCCAGCAGGTTCTCCAACTTCTACTGAAGAAGGTTCTA CCAGCTCTACCGCAGAATCTCCTGGTCCAGGTACCTCTACTCCG GAAAGCGGCTCTGCATCTCCAGGTTCTACTAGCGAATCTCCTTC TGGCACTGCACCAGGTTCTACTAGCGAATCCCCGTCTGGTACTG CTCCAGGTACTTCTACTCCTGAAAGCGGTTCCGCTTCTCCAGGT AGCACCTCTACTCCGGAAAGCGGTTCTGCATCTCCAGGTAGCGAACC GGCAACCTCCGGCTCTGAAACCCCAGGTACCTCTGAAAGCGCT ACTCCTGAATCCGGCCCAGGTAGCCCGGCAGGTTCTCCGACTTC CACTGAGGAAGGTACCTCTACTGAACCTTCTGAGGGCAGCGCT CCAGGTACTTCTGAAAGCTCCGGAGTCCGGTCCAGGTA CTTCTACTGAACCGTCCGAAGGTAGCGCACCAGGTACTTCTACC GAACCGTCCGAGGGTAGCGCACCAGGTAGCCCAGCAGGTTCTC CTACCTCCACCGAGGAAGGTACTTCTACCGAACCGTCCGAGGG TAGCGCACCAGGTACTTCTACCGAACCGTCCGAGGGCAGCGCA CCAGGTACTTCTGAAAGCGCTACCCCTGAGTCCGGCCCAGGTA CTTCTGAAAGCGCTACTCCTGAATCCGGTCCAGGTACCTCTACT GAACCTTCCGAAGGCAGCGCTCCAGGTACCTCTACCGAACCGT CCGAGGGCAGCGCACCAGGTACTTCTGAAAGCGCAACCCCTGA ATCCGGTCCAGGTACTTCTACTGAACCTTCCGAAGGTAGCGCTC CAGGTAGCGAACCTGCTACTTCTGGTTCTGAAACCCCAGGTAGC CCGGCTGGCTCTCCGACCTCCACCGAGGAAGGTAGCTCTACCCC GTCTGGTGCTACTGGTTCTCCAGGTACTCCGGGCAGCGGTACTG CTTCTTCCTCTCCAGGTAGCTCTACCCCTTCTGGTGCTACTGGCT CTCCAGGTACCTCTACCGAACCGTCCGAGGGTAGCGCACCAGG TACCTCTACTGAACCGTCTGAGGGTAGCGCTCCAGGTAGCGAA CCGGCAACCTCCGGTTCTGAAACCCCAGGTAGCCCTGCTGGCTC TCCGACTTCTACTGAGGAAGGTAGCCCGGCTGGTTCTCCGACTT CTACTGAGGAAGGTACTTCTACCGAACCTTCCGAAGGTAGCGC TCCAGGTGCAAGCGCAAGCGGCGCGCCAAGCACGGGAGGTACT TCTGAAAGCGCTACTCCTGAGTCCGGCCCAGGTAGCCCGGCTG GCTCTCCGACTTCCACCGAGGAAGGTAGCCCGGCTGGCTCTCCA ACTTCTACTGAAGAAGGTTCTACCAGCTCTACCGCTGAATCTCC TGGCCCAGGTTCTACTAGCGAATCTCCGTCTGGCACCGCACCAG GTACTTCCCCTAGCGGTGAATCTTCTACTGCACCAGGTACCCCT GGCAGCGGTACCGCTTCTTCCTCTCCAGGTAGCTCTACCCCGTC TGGTGCTACTGGCTCTCCAGGTTCTAGCCCGTCTGCATCTACCG GTACCGGCCCAGGTAGCGAACCGGCAACCTCCGGCTCTGAAAC TCCAGGTACTTCTGAAAGCGCTACTCCGGAATCCGGCCCAGGT AGCGAACCGGCTACTTCCGGTTCTGAAACCCCAGGTTCCACCA GCTCTACTGCAGAATCTCCGGGCCCAGGTTCTACTAGCTCTACT GCAGAATCTCCGGGTCCAGGTACTTCTCCTAGCGGCGAATCTTC TACCGCTCCAGGTAGCGAACCGGCAACCTCTGGCTCTGAAACT CCAGGTAGCGAACCGGCTACCTCCGGCTCTGAAACCCCAGGTA CTTCTACTGAACCTTCTGAGGGCAGCGCACCAGGTTCTACCAGC TCTACCGCAGAATCTCCTGGTCCAGGTACCTCTACTCCGGAAAG CGGCTCTGCATCTCCAGGTTCTACTAGCGAATCTCCTTCTGGCA CTGCACCAGGTACTTCTACCGAACCGTCCGAAGGCAGCGCTCC AGGTACCTCTACTGAACCTTCCGAGGGCAGCGCTCCAGGTACCT CTACCGAACCTTCTGAAGGTAGCGCACCAGGTAGCTCTACTCCG TCTGGTGCAACCGGCTCCCCAGGTTCTAGCCCGTCTGCTTCCAC TGGTACTGGCCCAGGTGCTTCCCCGGGCACCAGCTCTACTGGTT CTCCAGGTAGCGAACCTGCTACCTCCGGTTCTGAAACCCCAGGT | 794 |

TABLE 36-continued

Exemplary GHXTEN comprising growth hormones and two XTEN sequences

| GHXTEN Name* | Amino Acid Sequence | SEQ ID NO: | DNA Nucleotide Sequence | SEQ ID NO: |
|---|---|---|---|---|
| | TGPGASPGTSSTGSP GTSESATPESGPGTS TEPSEGSAPGTSTEPS EGSAPGFPTIPLSRLF DNAMLRAHRLHQL AFDTYQEFEEAYIPK EQKYSFLQNPQTSLC FSESIPTPSNREETQQ KSNLELLRISLLLIQS WLEPVQFLRSVFAN SLVYGASDSNVYDL LKDLEEGIQTLMGRL EDGSPRTGQIFKQTY SKFDTNSHNDDALL KNYGLLYCFRKDMD KVETFLRIVQCRSVE GSCGFGGTSESATPE SGPGSEPATSGSETP GTSESATPESGPGSE PATSGSETPGTSESA TPESGPGTSTEPSEGS APGSPAGSPTSTEEG TSESATPESGPGSEP ATSGSETPGTSESAT PESGPGSPAGSPTSTE EGSPAGSPTSTEEGT STEPSEGSAPGTSES ATPESGPGTSESATP ESGPGTSESATPESG PGSEPATSGSETPGS EPATSGSETPGSPAG SPTSTEEGTSTEPSEG SAPGTSTEPSEGSAP GSEPATSGSETPGTS ESATPESGPGTSTEPS EGSAP | | ACCTCTGAAAGCGCAACTCCGGAGTCTGGTCCAGGTAGCCCTG CAGGTTCTCCTACCTCCACTGAGGAAGGTAGCTCTACTCCGTCT GGTGCAACCGGCTCCCCAGGTTCTAGCCCGTCTGCTTCCACTGG TACTGGCCCAGGTGCTTCCCCGGGCACCAGCTCTACTGGTTCTC CAGGTACCTCTGAAAGCGCTACTCCGGAGTCTGGCCCAGGTAC CTCTACTGAACCGTCTGAGGGTAGCGCTCCAGGTACTTCTACTG AACCGTCCGAAGGTAGCGCACCAGGTTTTCCGACTATTCCGCTG TCTCGTCTGTTTGATAATGCTATGCTGCGTGCGCACCGTCTGCA CCAGCTGGCCTTTGATACTTACCAGGAATTTGAAGAAGCTACA TTCCTAAAGAGCAGAAGTACTCTTTCCTGCAAAACCCACAGACT TCTCTCTGCTTCAGCGAATCTATTCCGACGCCTTCCAATCGCGA GGAAACTCAGCAAAAGTCCAATCTGGAACTACTCCGCATTTCTC TGCTTCTGATTCAGAGCTGGCTAGAACCAGTGCAATTTCTGCGT TCCGTCTTCGCCAATAGCCTAGTTTATGGCGCATCCGACAGCAA CGTATACGATCTCCTGAAAGATCTCGAGGAAGGCATTCAGACC CTGATGGGTCGTCTCGAGGATGGCTCTCCGCGTACTGGTCAGAT CTTCAAGCAGACTTACTCTAAATTTGATACTAACAGCCACAATG ACGATGCGCTTCTAAAAAACTATGGTCTGCTGTATTGTTTTCGT AAAGATATGGACAAAGTTGAAACCTTCCTGCGTATTGTTCAGTG TCGTTCCGTTGAGGGCAGCTGTGGTTTCTAAGGTGGTACCTCTG AAAGCGCAACTCCTGAGTCTGGCCCAGGTAGCGAACCTGCTAC CTCCGGCTCTGAGACTCCAGGTACCTCTGAAAGCGCAACCCCG GAATCTGGTCCAGGTAGCGAACCTGCAACCTCTGGCTCTGAAA CCCCAGGTACCTCTGAAAGCGCTACTCCTGAATCTGGCCCAGGT ACTTCTACTGAACCGTCCGAGGGCAGCGCACCAGGTAGCCCTG CTGGCTCTCCAACCTCCACCGAAGAAGGTACCTCTGAAAGCGC AACCCCTGAATCCGGCCCAGGTAGCGAACCGGCAACCTCCGGT TCTGAAACCCCAGGTACTTCTGAAAGCGCTACTCCTGAGTCCGG CCCAGGTAGCCCCGGCTGGCTCTCCGACTTCCACCGAGGAAGGT AGCCCGGCTGGCTCTCCAACTTCTACTGAAGAAGGTACTTCTAC CGAACCTTCCGAGGGCAGCGCACCAGGTACTTCTGAAAGCGCT ACCCCTGAGTCCGGCCCAGGTACTTCTGAAAGCGCTACTCCTGA ATCCGGTCCAGGTACTTCTGAAAGCGCTACCCCGGAATCTGGCC CAGGTAGCGAACCGGCTACTTCTGGTTCTGAAACCCCAGGTAG CGAACCGGCTACCTCCGGTTCTGAAACTCCAGGTAGCCCCAGCA GGCTCTCCGACTTCCACTGAGGAAGGTACTTCTACTGAACCTTC CGAAGGCAGCGCACCAGGTACCTCTACTGAACCTTCTGAGGGC AGCGCTCCAGGTAGCGAACCTGCAACCTCTGGCTCTGAAACCC CAGGTACCTCTGAAAGCGCTACTCCTGAATCTGGCCCAGGTACT TCTACTGAACCGTCCGAGGGCAGCGCACCA | |
| AM1318-hGH-AE288 | GTSTEPSEGSAPGSE PATSGSETPGSPAGS PTSTEEGSTSSTAESP GPGTSTPESGSASPG STSESPSGTAPGSTSE SPSGTAPGTSTPESGS ASPGTSTPESGSASP GSEPATSGSETPGTS ESATPESGPGSPAGS PTSTEEGTSTEPSEGS APGTSESATPESGPG TSTEPSEGSAPGTSTE PSEGSAPGSPAGSPT STEEGTSTEPSEGSAP GTSTEPSEGSAPGTS ESATPESGPGTSESA TPESGPGTSTEPSEGS APGTSTEPSEGSAPG TSESATPESGPGTSTE PSEGSAPGSEPATSG SETPGSPAGSPTSTEE GSSTPSGATGSPGTP GSGTASSSPGSSTPS GATGSPGTSTEPSEG SAPGTSTEPSEGSAP GSEPATSGSETPGSP AGSPTSTEEGSPAGS PTSTEEGSPAGSPTSG APGPEPTGPAPSGGS EPATSGSETPGTSES ATPESGPGSPAGSPT STEEGTSESATPESGP GSPAGSPTSTEEGSP | 795 | GGTACTTCTACTGAACCGTCTGAAGGCAGCGCACCAGGTAGCG AACCGGCTACTTCCGGTTCTGAAACCCCAGGTAGCCCAGCAGG TTCTCCAACTTCTACTGAAGAAGGTACCAGCTCTACCGCAGA AATCTCCTGGTCAGGTACCTCTACTCCGGAAAGCGGCTCTGCA TCTCCAGGTTCTACTAGCGAATCCCCGTCTGGTACTGCTCCAGG TACTTCTACTCCGGAAAGCGGTTCTGCATCTCCAGGTAGCGAACCGGCAACCTCCGGCT CTGAAACCCCAGGTACCTCTGAAAGCGCTACTCCTGAATCCGG CCCAGGTAGCCCGGCAGGTTCTCCGACTTCCACTGAGGAAGGT ACCTCTACTGAACCTTCTGAGGGCAGCTCCAGGTACTTCTGA AAGCGCTACCCCGGAGTCCGGTCCAGGTACTTCTACTGAACCGT CCGAAGGTAGCGCACCAGGTACTTCTACCGAACCGTCCGAGGG TAGCGCACCAGGTAGCCCAGCAGGTTCTCCTACCTCCACCGAG GAAGGTACTTCTACCGAACCGTCCGAGGGTAGCGCACCAGGTA CTTCTACCGAACCTTCCGAGGGCAGCGCACCAGGTACTTCTGAA AGCGCTACCCCTGAGTCCGGCCCAGGTACTTCTGAAAGCGCTA CCCTGAATCCGGTCCAGGTACCTCTACTGAACCTTCCGAAGGC AGCGCTCCAGGTACCTCTACCGAACCGTCCGAGGGCAGCGCAC CAGGTACTTCTGAAAGCGCAACCCCTGAATCCGGTCCAGGTAC TTCTACTGAACCTTCCGAAGGTAGCGCTCCAGGTAGCGAACCTG CTACTTCTGGTTCTGAAACCCCAGGTAGCCCGGCTGGCTCTCCG ACCTCCACCGAGGAAGGTAGCTCTACCCCGTCTGGTGCTACTGG TTCTCCAGGTACTCCGGGCAGCGGTACTGCTTCTTCCTCTCCAG GTAGCTCTACCCCTTCTGGTGCTACTGGCTCTCCAGGTACCTCT ACCGAACCGTCCGAGGGTAGCGCACCAGGTACCTCTACTGAAC CGTCTGAGGGTAGCGCTCCAGGTAGCGAACCGGCAACCTCCGG TTCTGAAACTCCAGGTAGCCCTGCTGGCTCTCCGACTTCTACTG AGGAAGGTAGCCCGGCTGGTTCTCCGACTTCTACTGAGGAAGG TACTTCTACCGAACCTTCCGAAGGTAGCGCTCCAGGTCCAGAAC CAACGGGGCCGGCCCCAAGCGGAGGTAGCGAACCGGCAACCTC CGGCTCTGAAACCCCAGGTACCTCTGAAAGCGCTACTCCTGAAT CCGGCCCAGGTAGCCCGGCAGGTTCTCCGACTTCCACTGAGGA | 796 |

TABLE 36-continued

Exemplary GHXTEN comprising growth hormones and two XTEN sequences

| GHXTEN Name* | Amino Acid Sequence | SEQ ID NO: | DNA Nucleotide Sequence | SEQ ID NO: |
|---|---|---|---|---|
| | AGSPTSTEEGTSESA | | AGGTACTTCTGAAAGCGCTACTCCTGAGTCCGGCCCAGGTAGC | |
| | TPESGPGSPAGSPTST | | CCGGCTGGCTCTCCGACTTCCACCGAGGAAGGTAGCCCGGCTG | |
| | EEGSPAGSPTSTEEG | | GCTCTCCAACTTCTACTGAAGGTACTTCTGAAAGCGCTACT | |
| | STSSTAESPGPGSTSE | | CCTGAGTCCGGCCCAGGTAGCCCGGCTGGCTCTCCGACTTCCAC | |
| | SPSGTAPGTSPSGESS | | CGAGGAAGGTAGCCCGGCTGGCTCTCCAACTTCTACTGAAGAA | |
| | TAPGSTSESPSGTAP | | GGTTCTACCAGCTCTACCGCTGAATCTCCTGGCCCAGGTTCTAC | |
| | GSTSESPSGTAPGTSP | | TAGCGAATCTCCGTCTGGCACCGCACCAGGTACTTCCCCTAGCG | |
| | SGESSTAPGTSTEPSE | | GTGAATCTTCTACTGCACCAGGTTCTACCAGCGAATCTCCTTCT | |
| | GSAPGTSESATPESG | | GGCACCGCTCCAGGTTCTACTAGCGAATCCCCGTCTGGTACCGC | |
| | PGTSESATPESGPGS | | ACCAGGTACTTCTCCTAGCGGCGAATCTTCTACCGCACCAGGTA | |
| | EPATSGSETPGTSES | | CTTCTACCGAACCTTCCGAGGCAGCGCACCAGGTACTTCTGAA | |
| | ATPESGPGTSESATP | | AGCGCTACCCCTGAGTCCGGCCCAGGTACTTCTGAAAGCGCTA | |
| | ESGPGTSTEPSEGSA | | CTCCTGAATCCGGTCCAGGTAGCGAACCGGCAACCTCTGGCTCT | |
| | PGTSESATPESGPGT | | GAAACCCCAGGTACCTCTGAAAGCGCTACTCCGGAATCTGGTC | |
| | STEPSEGSAPGTSPSG | | CAGGTACTTCTGAAAGCGCTACTCCGGAATCCGGTCCAGGTAC | |
| | ESSTAPGTSPSGESST | | CTCTACTGAACCTTCTGAGGGCAGCGCTCCAGGTACTTCTGAAA | |
| | APGTSPSGESSTAPG | | GCGCTACCCCGGAGTCCGGTCCAGGTACTTCTACTGAACCGTCC | |
| | TSTEPSEGSAPGSPA | | GAAGGTAGCGCACCAGGTACCTCCCCTAGCGGCGAATCTTCTA | |
| | GSPTSTEEGTSTEPSE | | CTGCTCCAGGTACTTCTCCTAGCGGCGAATCTTCTACCGCTCCA | |
| | GSAPGSSPSASTGTG | | GGTACCTCCCCTAGCGGTGAATCTTCTACCGCACCAGGTACTTC | |
| | PGSSTPSGATGSPGS | | TACCGAACCGTCCGAGGGTAGCGCACCAGGTAGCCCAGCAGGT | |
| | STPSGATGSPGSSTPS | | TCTCCTACCTCCACCGAGGAAGGTACTTCTACCGAACCGTCCGA | |
| | GATGSPGSSTPSGAT | | GGGTAGCGCACCAGGTTCTAGCCCTTCTGCTTCCACCGGTACCG | |
| | GSPGASPGTSSTGSP | | GCCCAGGTAGCTCTACTCCGTCTGGTGCAACTGGCTCTCCAGGT | |
| | GASASGAPSTGGTSP | | AGCTCTACTCCGTCTGGTGCAACCGGCTCCCCAGGTAGCTCTAC | |
| | SGESSTAPGSTSSTA | | CCCGTCTGGTGCTACCGGCTCTCCAGGTAGCTCTACCCCGTCTG | |
| | ESPGPGTSPSGESSTA | | GTGCAACCGGCTCCCCAGGTGCATCCCCGGGTACTAGCTCTACC | |
| | PGTSESATPESGPGT | | GGTTCTCCAGGTGCAAGCGCAAGCGGCGCGCAAGCACGGGAG | |
| | STEPSEGSAPGTSTEP | | GTACTTCTCCGAGCGGTGAATCTTCTACCGCACCAGGTTCTACT | |
| | SEGSAPGSSPSASTG | | AGCTCTACCGCTGAATCTCCGGGCCCAGGTACTTCTCCGAGCGG | |
| | TGPGSSTPSGATGSP | | TGAATCTTCTACTGCTCCAGGTACCTCTGAAAGCGCTACTCCGG | |
| | GASPGTSSTGSPGTS | | AGTCTGGCCCAGGTACCTCTACTGAACCGTCTGAGGGTAGCGCT | |
| | TPESGSASPGTSPSGE | | CCAGGTACTTCTACTGAACCGTCCGAAGGTAGCGCACCAGGTT | |
| | SSTAPGTSPSGESSTA | | CTAGCCCTTCTGCATCTACTGGTACTGGCCCAGGTAGCTCTACT | |
| | PGTSESATPESGPGS | | CCTTCTGGTGCTACCGGCTCTCCAGGTGCTTCTCCGGGTACTAG | |
| | EPATSGSETPGTSTEP | | CTCTACCGGTTCTCCAGGTACTTCTACTCCGGAAAGCGGTTCCA | |
| | SEGSAPGSTSESPSGT | | CATCTCCAGGTACTTCTCCTAGCGGTGAATCTTCTACTGCTCCA | |
| | APGSTSESPSGTAPG | | GGTACCTCTCCTAGCGGCGAATCTTCTACTGCTCCAGGTACTTC | |
| | TSTPESGSASPGSPA | | TGAAAGCGCAACCCCTGAATCCGGTCCAGGTAGCGAACCGGCT | |
| | GSPTSTEEGTSESATP | | ACTTCTGGCTCTGAGACTCCAGGTACTTCTACCGAACCGTCCGA | |
| | ESGPGTSTEPSEGSA | | AGGTAGCGCACCAGGTTCTACCAGCGAATCCCCTTCTGGTACTG | |
| | PGSPAGSPTSTEEGT | | CTCCAGGTTCTACCAGCGAATCCCCTTCTGGCACCGCACCAGGT | |
| | SESATPESGPGSEPA | | ACTTCTACCCCTGAAAGCGGCTCCGCTTCTCCAGGTAGCCCGGC | |
| | TSGSETPGSSTPSGA | | AGGCTCTCCGACCTCTACTGAGGAAGGTACTTCTGAAAGCGCA | |
| | TGSPGASPGTSSTGS | | ACCCCGGAGTCCGGCCCAGGTACCTCTACCGAACCGTCTGAGG | |
| | PGSSTPSGATGSPGS | | GCAGCGCACCAGGTAGCCCTGCTGGCTCTCCAACCTCCACCGA | |
| | TSESPSGTAPGTSPSG | | AGAAGGTACCTCTGAAAGCGCAACCCCTGAATCCGGCCCAGGT | |
| | ESSTAPGSTSSTAESP | | AGCGAACCGGCAACCTCCGGTTCTGAAACCCCAGGTAGCTCTA | |
| | GPGSSTPSGATGSPG | | CCCCGTCTGGTGCTACCGGTTCCCCAGGTGCTTCTCCTGGTACT | |
| | ASPGTSSTGSPGTPG | | AGCTCTACCGGTTCTCCAGGTAGCTCTACCCCGTCTGGTGCTAC | |
| | SGTASSSPGSPAGSP | | TGGCTCTCCAGGTTCTACTAGCGAATCCCCGTCTGGTACTGCTC | |
| | TSTEEGSPAGSPTSTE | | CAGGTACTTCCCCTAGCGGTGAATCTTCTACTGCTCCAGGTTCT | |
| | EGTSTEPSEGSAPGF | | ACCAGCTCTACCGCAGAATCTCCGGGTCCAGGTAGCTCTACCCC | |
| | PTIPLSRLFDNAMLR | | TTCTGGTGCAACCGGCTCTCCAGGTGCATCCCCGGGTACCAGCT | |
| | AHRLHQLAFDTYQE | | CTACCGGTTCTCCAGGTACTCCGGGTAGCGGTACCGCTTCTTCC | |
| | FEEAYIPKEQKYSFL | | TCTCCAGGTAGCCCTGCTGGCTCTCCGACTTCTACTGAGGAAGG | |
| | QNPQTSLCFSESIPTP | | TAGCCCGGCTGGTTCTCCGACTTCTACTGAGGAAGGTACTTCTA | |
| | SNREETQQKSNLELL | | CCGAACCTTCCGAAGGTAGCGCTCCAGGTTTTCCGACTATTCCG | |
| | RISLLLIQSWLEPVQF | | CTGTCTCGTCTGTTTGATAATGCTATGCTGCGTGCGCACCGTCT | |
| | LRSVFANSLVYGAS | | GCACCAGCTGGCCTTTGATACTTACCAGGAATTTGAAGAAGCcT | |
| | DSNVYDLLKDLEEGI | | ACATTCCTAAAGAGCAGAAGTACTCTTTCCTGCAAAACCCACA | |
| | QTLMGRLEDGSPRT | | GACTTCTCTCTGCTTCAGCGAATCTATTCCGACGCCTTCCAATC | |
| | GQIFKQTYSKFDTNS | | GCGAGGAAACTCAGCAAAGTCCAATCTGGAACTACTCCGCAT | |
| | HNDDALLKNYGLLY | | TTCTCTGCTTCTGATTCAGAGCTGGCTAGAACCAGTGCAATTTC | |
| | CFRKDMDKVETFLRI | | TGCGTTCCGTCTTCGCCAATAGCCTAGTTTATGGCGCATCCGAC | |
| | VQCRSVEGSCGFGG | | AGCAACGTATACGATCTCCTGAAAGATCTCGAGGAAGGCATTC | |
| | TSESATPESGPGSEP | | AGACCCTGATGGGTCGTCTCGAGGATGGCTCTCCGCGTACTGGT | |
| | ATSGSETPGTSESAT | | CAGATCTTCAAGCAGACTTACTCTAAATTTGATACTAACAGCCA | |
| | PESGPGSEPATSGSE | | CAATGACGATGCGCTTCTAAAAAACTATGGTCTGCTGTATTGTT | |
| | TPGTSESATPESGPG | | TTCGTAAAGATATGGACAAAGTTGAAACCTTCCTGCGTATTGTT | |
| | TSTEPSEGSAPGSPA | | CAGTGTCGTTCCGTTGAGGGCAGCTGTGGTTTCTAAGGTGGTAC | |
| | GSPTSTEEGTSESATP | | CTCTGAAAGCGCAACTCCTGAGTCTGGCCCAGGTAGCGAACCT | |
| | ESGPGSEPATSGSET | | GCTACCTCCGGCTCTGAGACTCCAGGTACCTCTGAAAGCGCAA | |
| | PGTSESATPESGPGSP | | CCCCGGAATCTGGTCCAGGTAGCGAACCTGCAACCTCTGGCTCT | |

TABLE 36-continued

Exemplary GHXTEN comprising growth hormones and two XTEN sequences

| GHXTEN Name* | Amino Acid Sequence | SEQ ID NO: | DNA Nucleotide Sequence | SEQ ID NO: |
|---|---|---|---|---|
| | AGSPTSTEEGSPAGS PTSTEEGTSTEPSEGS APGTSESATPESGPG TSESATPESGPGTSES ATPESGPGSEPATSG SETPGSEPATSGSETP GSPAGSPTSTEEGTS TEPSEGSAPGTSTEPS EGSAPGSEPATSGSE TPGTSESATPESGPG TSTEPSEGSAP | | GAAACCCCAGGTACCTCTGAAAGCGCTACTCCTGAATCTGGCC CAGGTACTTCTACTGAACCGTCTCCGAGGGCAGCGCACCAGGTAG CCCTGCTGGCTCTCCAACCTCCACCGAAGAAGGTACCTCTGAAA GCGCAACCCCTGAATCCGGCCCAGGTAGCGAACCGGCAACCTC CGGTTCTGAAACCCCAGGTACTTCTGAAAGCGCTACTCCTGAGT CCGGCCCAGGTAGCCCGGCTGGCTCTCCGACTTCCACCGAGGA AGGTAGCCCGGCTGGCTCTCCAACTTCTACTGAAGAAGGTACTT CTACCGAACCTTCCGAGGGCAGCGCACCAGGTACTTCTGAAAG CGCTACCCCTGAGTCCGCCCAGGTACTTCTGAAAGCGCTACTC CTGAATCCGGTCCAGGTACTTCTGAAAGCGCTACCCCGGAATCT GGCCCAGGTAGCGAACCGGCTACTTCTGGTTCTGAAACCCCAG GTAGCGAACCGGCTACCTCCGGTTCTGAAACTCCAGGTAGCCC AGCAGGCTCTCCGACTTCCACTGAGGAAGGTACTTCTACTGAAC CTTCCGAAGGCAGCGCACCAGGTACCTCTACTGAACCTTCTGAG GGCAGCGCTCCAGGTAGCGAACCTGCAACCTCTGGCTCTGAAA CCCCAGGTACCTCTGAAAGCGCTACTCCTGAATCTGGCCCAGGT ACTTCTACTGAACCGTCCGAGGGCAGCGCACCA | |

*Sequence name reflects N- to C-terminus configuration of the growth factor and XTEN components

TABLE 37

Exemplary GHXTEN comprising growth hormones, XTEN and cleavage sequences

| GHXTEN Name* | Amino Acid Sequence | SEQ ID NO: | DNA Nucleotide Sequence | SEQ ID NO: |
|---|---|---|---|---|
| AE912-hGH-Thrombin-AE144 | MAEPAGSPTSTEEGT PGSGTASSSPGSSTPS GATGSPGASPGTSST GSPGSPAGSPTSTEE GTSESATPESGPGTS TEPSEGSAPGSPAGS PTSTEEGTSTEPSEGS APGTSTEPSEGSAPG TSESATPESGPGSEP ATSGSETPGSEPATS GSETPGSPAGSPTST EEGTSESATPESGPG TSTEPSEGSAPGTSTE PSEGSAPGSPAGSPT STEEGTSTEPSEGSAP GTSTEPSEGSAPGTS ESATPESGPGTSTEPS EGSAPGTSESATPES GPGSEPATSGSETPG TSTEPSEGSAPGTSTE PSEGSAPGTSESATP ESGPGTSESATPESG PGSPAGSPTSTEEGT SESATPESGPGSEPA TSGSETPGTSESATPE SGPGTSTEPSEGSAP GTSTEPSEGSAPGTS TEPSEGSAPGTSTEPS EGSAPGTSESATPES GPGTSTEPSEGSAPG GPGSEPATSGSETPG TSESATPESGPGSPA GSPTSTEEGSPAGSP AGSPTSTEEGSPAGS PTSTEEGTSESATPES GSAPGTSESATPESG PGSPAGSPTSTEEGS PAGSPTSTEEGSPAGS PTSTEEGTSTEPSEGS APGTSESATPESGPGSEP ATSGSETPGTSESAT PESGPGSEPATSGSE TPGTSESATPESGPG | 797 | ATGGCTGAACCTGCTGGCTCTCCAACCTCCACTGAGGAAGGTA CCCCGGGTAGCGGTACTGCTTCTTCCTCTCCAGGTAGCTCTACC CCTTCTGGTGCAACCGGCTCTCCAGGTGCTTCTCCGGGCACCAG CTCTACCGGTTCTCCAGGTAGCCCGGCTGGCTCTCCTACCTCTA CTGAGGAAGGTACTTCTGAAAGCGCTACTCCTGAGTCTGGTCCA GGTACCTCTACTGAACCGTCCGAAGGTAGCGCTCCAGGTAGCC CAGCAGGCTCTCCGACTTCCACTGAGGAAGGTACTTCTACTGAA CCTTCCGAAGGCAGCGCACCAGGTACCTCTACTGAACCTTCTGA GGGCAGCGCTCCAGGTACTTCTGAAAGCGCTACCCCGGAATCT GGCCCAGGTAGCGAACCGGCTACTTCTGGTTCTGAAACCCCAG GTAGCGAACCGGCTACCTCCGGTTCTGAAACTCCAGGTAGCCC GGCAGGCTCTCCGACCTCTACTGAGGAAGGTACTTCTGAAAGC GCAACCCCGGAGTCCGGCCCAGGTACCTCTACCGAACCGTCTG AGGGCAGCGCACCAGGTACTTCTACCGAACCGTCCGAGGGTAG CGCACCAGGTAGCCCAGCGGGTTCTCCTACCTCCACCGAGGAA GGTACTTCTACCGAACCGTCCGAGGGTAGCGCACCAGGTACCT CTACTGAACCTTCTGAGGGCAGCGCTCCAGGTACTTCTGAAAGC GCTACCCCGGAGTCCGGTCCAGGTACTTCTACTGAACCGTCCGA AGGTAGCGCACCAGGTACTTCTGAAAGCGCAACCCCTGAATCC GGTCCAGGTAGCGAACCTGCTACTTCTGGCTCTGAGACTCCAG GTACTTCTACCGAACCGTCCGAAGGTAGCGCACCAGGTACTTCT ACTGAACCGTCTGAAGGTAGCGCACCAGGTACTTCTGAAAGCG CAACCCCGGAATCCGGCCCAGGTACCTCTGAAAGCGCAACCCC GGAGTCCGGCCCAGGTGCTGGCTCTCCAACCTCCACCG AAGAAGGTACCTCTGAAAGCGCAACCCCTGAATCCGGCCCAGG TAGCGAACCGGCAACCTCCGGTTCTGAAACCCCAGGTACCTCT GAAAGCGCTACTCCGGAGTCTGGCCCAGGTACCTCTACTGAAC CGTCTGAGGGTAGCGCTCCAGGTACTTCTACTGAACCGTCTA GGTAGCGCACCAGGTACTTCTACCGAACCGTCCGAAGGCAGCG CTCCAGGTACCTCTACTGAACCTTCCGAGGGCAGCGCTCCAGGT ACCTCTACCGAACCTTCTGAAGGTAGCGCACCAGGTACTTCTAC CGAACCGTCCGAGGGCAGCGCTCCAGGTAGCCCAGCAGGTTCT CCTACCTCCACCGAGGAAGGTACTTCTACCGAACCGTCCGAGG GTAGCGCACCAGGTACCTCTGAAAGCGCAACTCCTGAGTCTGG CCCAGGTAGCGAACCTGCTACCTCCGGCTCTGAGACTCCAGGT ACCTCTGAAAGCGCAACCCCAGGTACTTGTCAGGTAGCGAAC CTGCAACCTCTGGCTCTGAAACCCCAGGTACCTCTGAAAGCGCT ACTCCTGAATCTGGCCCAGGTACTTCTACTGAACCGTCCGAGGG CAGCGCACCAGGTACTTCTGAAAGCGCTACTCCTGAGTCCGGC CCAGGTAGCCCGGCTGGCTCTCCAACTTCTACTGAAGAAGGTAG CCCGGCTGGCTCTCCAACTTCTACTGAAGAAGGTAGCCCGGC AGGCTCTCCGACCTCTACTGAGGAAGGTACTTCTGAAAGCGCA ACCCCGGAGTCCGCCCAGGTACCTCTACCGAACCGTCTGAGG GCAGCGCACCAGGTACCTCTGAAAGCGCAACTCCTGAGTCTGG CCCAGGTAGCGAACCTGCTACCTCCGGCTCTGAGACTCCAGGT | 798 |

TABLE 37-continued

Exemplary GHXTEN comprising growth hormones, XTEN and cleavage sequences

| GHXTEN Name* | Amino Acid Sequence | SEQ ID NO: | DNA Nucleotide Sequence | SEQ ID NO: |
|---|---|---|---|---|
| | TSTEPSEGSAPGSPA GSPTSTEEGTSESATP ESGPGSEPATSGSET PGTSESATPESGPGSP AGSPTSTEEGSPAGS PTSTEEGTSTEPSEGS APGTSESATPESGPG TSESATPESGPGTSES ATPESGPGSEPATSG SETPGSEPATSGSETP GSPAGSPTSTEEGTS TEPSEGSAPGTSTEPS EGSAPGSEPATSGSE TPGTSESATPESGPG TSTEPSEGSAPGFPTI PLSRLFDNAMLRAH RLHQLAFDTYQEFEE AYIPKEQKYSFLQNP QTSLCFSESIPTPSNR EETQQKSNLELLRIS LLLIQSWLEPVQFLR SVFANSLVYGASDS NVYDLLKDLEEGIQT LMGRLEDGSPRTGQI FKQTYSKFDTNSHN DDALLKNYGLLYCF RKDMKVETFLRIV QCRSVEGSCGFGLTP RSLLVGGGGSEPATS GSETPGTSESATPES GPGSEPATSGSETPG SPAGSPTSTEEGTSTE PSEGSAPGSEPATSG SETPGSEPATSGSETP GSEPATSGSETPGTS TEPSEGSAPGTSESA TPESGPGSEPATSGS ETPGTSTEPSEGSAP | | ACCTCTGAAAGCGCAACCCCGGAATCTGGTCCAGGTAGCGAAC CTGCAACCTCTGGCTCTGAAACCCCAGGTACCTCTGAAAGCGCT ACTCCTGAATCGGTCCAGGTACTTCTGAACCGTCCGAGGG CAGCGCACCAGGTAGCCCTGCTGGCTCTCCAACCTCCACCGAA GAAGGTACCTCTGAAAGCGCAACCCCTGAATCCGGCCCAGGTA GCGAACCGGCAACCTCCGGTTCTGAAACCCCAGGTACTTCTGA AAGCGCTACTCCTGAGTCCGGCCCAGGTAGCCCCGGCTGGCTCTC CGACTTCCACCGAGGAAGGTAGCCCCGGCTGGCTCTCCAACTTCT ACTGAAGAAGGTACTTCTACCGAACCTTCCGAGGGCAGCGCAC CAGGTACTTCTGAAAGCGCTACCCCTGAGTCCGGCCCAGGTACT TCTGAAAGCGCTACTCCTGAATCCGGTCCAGGTACTTCTGAAAG CGCTACCCCGGAATCTGGCCCAGGTAGCGAACCGGCTACTTCT GGTTCTGAAACCCCAGGTAGCGAACCGGCTACCTCCGGTTCTG AAACTCCAGGTAGCCCAGCAGGCTCTCCGACTTCCACTGAGGA AGGTACTTCTACTGAACCTTCCGAAGGCAGCGCACCAGGTACC TCTGAACCTTCCGAGGGCAGCGCTCCAGGTAGCGAACCGGCTAC CCAACCTCTGGCTCTGAAACCCCAGGTACCTCTGAAAGCGCTACT CCTGAATCGGCCCAGGTACTTCTACTGAACCGTCCGAGGGCA GCGCACCAGGTTTTCCGACTATTCCGCTGTCTCGTCTGTTTGAT AATGCTATGCTGCGTGCGCACCGTCTGCACCAGCTGGCCTTTGA TACTTACCAGGAATTTGAAGAAGCTACATTCCTAAAGAGCAGA AGTACTCTTTCCTGCAAAACCCACAGACTTCTCTCTGCTTCAGC GAATCTATTCCGACGCCTTCCAATCGCGAGGAAACTCAGCAAA AGTCCAATCTGGAACTACTCCGCATTTCTCTGCTTCTGATTCAG AGCTGGCTAGAACCAGTGCAATTTCTGCGTTCCGTCTTCGCCAA TAGCCTAGTTTATGGCGCATCCGACAGCAACGTATACGATCTCC TGAAAGATCTCGAGGAAGGCATTCAGACCCTGATGGGTCGTCT CGAGGATGGCTCTCCGCGTACTGGTCAGATCTTCAAGCAGATT ACTCTAAATTTGATACTAACAGCCACAATGACGATGCGCTTCTA AAAAACTATGGTCTGCTGTATTGTTTTCGTAAAGATATGGACAA AGTTGAAACCTTCCTGCGTATTGTTCAGTGTCGTTCCGTTGAGG GCAGCTGTGGTTTCTAAGGTctgacccgcgcagcctgctggtgggcggcGGTG GTAGCGAACCGGCAACTTCCGGCTCTGAAACCCCAGGTACTTCT GAAAGCGCTACTCCTGAGTCTGGCCCAGGTAGCGAACCTGCTA CCTCTGGCTCTGAAACCCCAGGTAGCCCGGCAGGCTCTCCGACT TCCACCGAGGAAGGTACCTCTACTGAACCTTCTGAGGGTAGCG CTCCAGGTAGCGAACCGGCAACCTCTGGCTCTGAAACCCCAGG TAGCGAACCTGCTACCTCCGGCTCTGAAACTCCAGGTAGCGAA CCGGCTACTTCCGGTTCTGAAACTCCAGGTACCTCTACCGAACC TTCCGAAGGCAGCGCACCAGGTACTTCTGAAAGCGCAACCCCT GAATCCGGTCCAGGTAGCGAACCGGCTACTTCTGGCTCTGAGA CTCCAGGTACTTCTACCGAACCGTCCGAAGGTAGCGCACCA | |
| AE912-<br>hGH-<br>FXIa-<br>AE144 | MAEPAGSPTSTEEGT PGSGTASSSPGSSTPS GATGSPGASPGTSST GSPGSPAGSPTSTEE GTSESATPESGPGTS TEPSEGSAPGSPAGS PTSTEEGTSTEPSEGS APGTSTEPSEGSAPG TSESATPESGPGSEP ATSGSETPGSEPATS GSETPGSPAGSPTST EEGTSESATPESGPG TSTEPSEGSAPGTSTE PSEGSAPGSPAGSPT STEEGTSTEPSEGSAP GTSTEPSEGSAPGTS ESATPESGPGTSTEPS EGSAPGTSESATPES GPGSEPATSGSETPG TSTEPSEGSAPGTSTE PSEGSAPGTSESATP ESGPGTSESATPESG PGSPAGSPTSTEEGT SESATPESGPGSEPA TSGSETPGTSESATPE SGPGTSTEPSEGSAP GTSTEPSEGSAPGTS TEPSEGSAPGTSTEPS EGSAPGTSTEPSEGS APGTSTEPSEGSAPG SPAGSPTSTEEGTSTE PSEGSAPGTSESATP | 799 | ATGGCTGAACCTGCTGGCTCTCCAACCTCCACTGAGGAAGGTA CCCCGGGTAGCGGTACTGCTTCTTCCTCTCCAGGTAGCTCTACC CCTTCTGGTGCAACCGGCTCTCCAGGTGCTTCTCCGGGCACCAG CTCTACCGGTTCTCCAGGTAGCCCCGGCTGGCTCTCCTACCTCTA CTGAGGAAGGTACTTCTGAAAGCGCTACTCCTGAGTCTGGTCCA GGTACCTCTACTGAACCGTCCGAAGGTAGCGCTCCAGGTAGCC CAGCAGGCTCTCCGACTTCCACTGAGGAAGGTACTTCTACTGAA CCTTCCGAAGGCAGCGCACCAGGTACCTCTACTGAACCTTCTGA GGGCAGCGCTCCAGGTACTTCTGAAAGCGCTACCCCGGAATCT GGCCCAGGTAGCGAACCTGCTTGTTCTGAAACCCCAG GTAGCGAACCGGCTACCTCCGGTTCTGAAACTCCAGGTAGCCC GGCAGGCTCTCCGACCTCTACTGAGGAAGGTACTTCTGAAAGC GCAACCCCGGAGTCCGGCCCAGGTACCTCTACCGAACCGTCTG AGGGCAGCGCACCAGGTTCTACCGAACCGTCCGAGGGTAG CGCACCAGGTAGCCCAGCAGGTTCTCCTACCTCCACCGAGGAA GGTACTTCTACCGAACCGTCCGAGGGTAGCGCACCAGGTACCT CTACTGAACCTTCTGAGGGCAGCGCTCCAGGTACTTCTGAAAGC GCTACCCCGGAGTCCGGTCCAGGTACTTCTGAAAGCGCAACCCCAGGTACTTCTACCGAACCGTCCGA AGGTAGCGAACCGGCTACTTCTGAAAGCGCAACCCCTGAATCC GGTCCAGGTAGCGAACCGGCTACTTCTGGCTCTGAGACTCCAG GTACTTCTACCGAACCGTCCGAAGGTAGCGCACCAGGTACTTCT ACTGAACCGTCTGAAGGTAGCGCACCAGGTACTTCTGAAAGCG CAACCCCGGAATCCGGCCCAGGTAGCGAACCGGCAACCCCAGG GGAGTCCGGCCCAGGTAGCCCTGCTGGCTCTCCAACCTCCACCG AAGAAGGTACCTCTGAAAGCGCAACCCCTGAATCCGGCCCAGG TAGCGAACCGGCAACCTCCGGTTCTGAAACCCCAGGTACCTCT GAAAGCGCTACTCCTGGCTCTGAAGTCTGAACTGCTCTACTGAA CGTCTGAGGGTAGCGCTCCAGGTACTTCTGAACCGTCCGAA GGTAGCGCACCAGGTACTTCTACCGAACCGTCCGAAGGCAGCG CTCCAGGTACCTCTACTGAACCTTCCGAGGGCAGCGCTCCAGGT ACCTCTACCGAACCTTCTGAAGGTAGCGCACCAGGTACTTCTAC CGAACCGTCCGAGGGTAGCGCACCAGGTAGCCCAGCAGGTTCT | 800 |

TABLE 37-continued

Exemplary GHXTEN comprising growth hormones, XTEN and cleavage sequences

| GHXTEN Name* | Amino Acid Sequence | SEQ ID NO: | DNA Nucleotide Sequence | SEQ ID NO: |
|---|---|---|---|---|
| | ESGPGSEPATSGSET PGTSESATPESGPGS EPATSGSETPGTSES ATPESGPGTSTEPSE GSAPGTSESATPESG PGSPAGSPTSTEEGSP AGSPTSTEEGSPAGS PTSTEEGTSESATPES GPGTSTEPSEGSAPG TSESATPESGPGSEP ATSGSETPGTSESAT PESGPGSEPATSGSE TPGTSESATPESGPG TSTEPSEGSAPGSPA GSPTSTEEGTSESATP ESGPGSEPATSGSET PGTSESATPESGPGSP AGSPTSTEEGSPAGS PTSTEEGTSTEPSEGS APGTSESATPESGPG TSESATPESGPGTSES ATPESGPGSEPATSG SETPGSEPATSGSETP GSPAGSPTSTEEGTS TEPSEGSAPGTSTEPS EGSAPGSEPATSGSE TPGTSESATPESGPG TSTEPSEGSAPGFPTI PLSRLFDNAMLRAH RLHQLAFDTYQEFEE AYIPKEQKYSFLQNP QTSLCFSESIPTPSNR EETQQKSNLELLRIS LLLIQSWLEPVQFLR SVFANSLVYGASDS NVYDLLKDLEEGIQT LMGRLEDGSPRTGQI FKQTYSKFDTNSHN DDALLKNYGLLYCF RKDMDKVETFLRIV QCRSVEGSCGFGGG KLTRVVGGGSEPA TSGSETPGTSESATPE SGPGSEPATSGSETP GSPAGSPTSTEEGTS TEPSEGSAPGSEPAT SGSETPGSEPATSGS ETPGSEPATSGSETP GTSTEPSEGSAPGTS ESATPESGPGSEPAT SGSETPGTSTEPSEGS AP | | CCTACCTCCACCGAGGAAGGTACTTCTACCGAACCGTCCGAGG GTAGCGCACCAGGTACCTCTGAAAGCGCAACTCCTGAGTCTGG CCCAGGTAGCGAACCTGCTACCTCCGGCTCTGAGACTCCAGGT ACCTCTGAAAGCGCAACCCCGGAATCTGGTCCAGGTAGCGAAC CTGCAACCTCTGGCTCTGAAACCCCAGGTACCTCTGAAAGCGCT ACTCCTGAATCTGGCCCAGGTACTTCTACTGAACCGTCCGAGGG CAGCGCACCAGGTACTTCTGAAAGCGCTACTCCTGAGTCCGGC CCAGGTAGCCCGGCTGGCTCTCCGACTTCCACCGAGGAAGGTA GCCCGGCTGGCTCTCCAACTTCTACTGAAGAAGGTAGCCCGGC AGGCTCTCCGACCTCTACTGAGGAAGGTACTTCTGAAAGCGCA ACCCCGGAGTCCGGCCCAGGTACCTCTACCGAACCGTCTGAGG GCAGCGCACCAGGTACCTCTGAAAGCGCAACTCCTGAGTCTGG CCCAGGTAGCGAACCTGCTACCTCCGGCTCTGAGACTCCAGGT ACCTCTGAAAGCGCAACCCCGGAATCTGGTCCAGGTAGCGAAC CTGCAACCTCTGGCTCTGAAACCCCAGGTACCTCTGAAAGCGCT ACTCCTGAATCTGGCCCAGGTACTTCTACTGAACCGTCCGAGGG CAGCGCACCAGGTAGCCCTGCTGGCTCTCCAACCTCCACCGAA GAAGGTACCTCTGAAAGCGCAACCCCTGAATCCGGCCCAGGTA GCGAACCGGCAACCTCCGGTTCTGAAACCCCAGGTACTTCTGA AAGCGCTACTCCTGAGTCCGGCCCAGGTAGCCCCGGCTGGCTC CGACTTCCACCGAGGAAGGTAGCCCCGGCTGGCTCTCCAACTTCT ACTGAAGAAGGTACTTCTACCGAACCTTCCGAGGGCAGCGCAC CAGGTACTTCTGAAAGCGCTACCCCTGAGTCCGGCCCAGGTACT TCTGAAAGCGCTACTCCTGAATCCGGTCCAGGTACTTCTGAAAG CGCTACCCCGAATCTGGCCCAGGTAGCGAACCGGCTACTTCT GGTTCTGAAACCCCAGGTAGCGAACCGGCTACCTCCGGTTCTG AAACTCCAGGTAGCCCAGCAGGCTCTCCGACTTCCACTGAGGA AGGTACTTCTGAACCTTCTGAAGGGCAGCGCTCCAGGTAGCGAACCTG CAACCTCTGGCTCTGAAACCCCAGGTACCTCTGAAAGCGCTACT CCTGAATCTGGCCCAGGTACTTCTACTGAACCGTCCGAGGGCA GCGCACCAGGTTTTCCGACTATTCCGCTGTCTCGTCTGTTTGAT AATGCTATGCTGCGTGCGCACCGTCTGCACCAGCTGGCCTTTGA TACTTACCAGGAATTTGAAGAAGCcTACATTCCTAAAGAGCAGA AGTACTCTTTCCTGCAAAACCCACAGACTTCTCTCTGCTTCAGC GAATCTATTCCGACGCCTTCCAATCGCGAGGAAACTCAGCAAA AGTCCAATCTGGAACTACTCCGCATTTCTCTGCTTCTGATTCAG AGCTGGCTAGAACCAGTGCAATTTCTGCGTTCCGTCTTCGCCAA TAGCCTAGTTTATGGCGCATCCGACAGCAACGTATACGATCTCC TGAAAGATCTCGAGGAAGGCATTCAGACCCTGATGGGTCGTCT CGAGGATGGCTCTCCGGTACTGGTCAGATCTTCAAGCAGACTT ACTCTAAATTTGATACTAACAGCCACAATGACGATGCGCTTCTA AAAAACTATGGTCTGCTGTATTGTTTTCGTAAAGATATGGACAA AGTTGAAACCTTCCTGCGTATTGTTCAGTGTCGTTCCGTTGAGG GCAGCTGTGGTTTCGGTggcggcaaactgacccgcgtggtgggcggcGGTG GTAGCGAACCGGCAACTTCCGGCTCTGAAACCCCAGGTACTTCT GAAAGCGCTACTCCTGAGTCTGGCCCAGGTAGCGAACCTGCTA CCTCTGGCTCTGAAACCCCAGGTAGCCCGGCAGGCTCTCCGACT TCCACCGAGGAAGGTACCTCTACTGAACCTTCTGAGGGTAGCG AACCGGCTACCTCCGGTTCTGAAACCCCAGG TAGCGAACCGGCAACCTCTGGCTCTGAAACCCCAGG TAGCGAACCTGCTACCTCCGGCTCTGAAACTCCAGGTAGCGAA CCGGCTACTTCCGGTTCTGAAACTCCAGGTACCTCTACCGAACC TTCCGAAGGCAGCGCACCAGGTACTTCTGAAGCGCAACCCT GAATCCGGTCCAGGTAGCGAACCGGCTACTTCTGGCTCTGAGA CTCCAGGTACTTCTACCGAACCGTCCGAAGGTAGCGCACCA | |
| AE912-hGH-Elastase-AE144 | MAEPAGSPTSTEEGT PGSGTASSSPGSSTPS GATGSPGASPGTSST GSPGSPAGSPTSTEE GTSESATPESGPGTS TEPSEGSAPGSPAGS PTSTEEGTSTEPSEGS APGTSTEPSEGSAPG TSESATPESGPGSEP ATSGSETPGSEPATS GSETPGSPAGSPTST EEGTSESATPESGPG TSTEPSEGSAPGTSTE PSEGSAPGSPAGSPT STEEGTSTEPSEGSAP GTSTEPSEGSAPGTS ESATPESGPGTSTEPS EGSAPGTSESATPES GPGSEPATSGSETPG | 801 | ATGGCTGAACCTGCTGGCTCTCCAACCTCCACTGAGGAAGGTA CCCCGGGTAGCGGTACTGCTTCTTCCTCTCCAGGTAGCTCTACC CCTTCTGGTGCAACCGGCTCTCCAGGTGCTTCTCCGGGCACCAG CTCTACCGGTTCTCCAGGTAGCCCCGGCTGCTCTCCTACCTCTA CTGAGGAAGGTACTTCTGAAAGCGCTACTCCTGAGTCTGGTCCA GGTACCTCTACTGAACCGTCCGAAGGTAGCGCTCCAGGTAGCC CAGCAGGCTCTCCGACTTCCACTGAGGAAGGTACTTCTACTGAA CCTTCCGAAGGCAGCGCACCAGGTACCTCTACTGAACCTTCTGA GGGCAGCGCTCCAGGTACTTCTGAAAGCGCTACCCCGGAATCT GGCCCAGGTAGCGAACCTGCTACTTCTGGTTCTGAAACCCCAG GTAGCGAACCGGCTACCTCCGGTTCTGAAACTCCAGGTAGCCC GGCAGGCTCTCCGACCTCTACTGAGGAAGGTACTTCTGAAAGC GCAACCCCGGAGTCCGGCCCAGGTACCTCTACCGAACCGTCTG AGGGCAGCGCACCAGGTACTTCTACCGAACCGTCCGAGGGTAG CGCACCAGGTAGCCCAGCAGGTTCTCCTACCTCCACCGAGGAA GGTACTTCTACCGAACCGTCCGAGGGCAGCGCTCCAGGTACCT CTACTGAACCTTCTGAGGGCAGCGCTCCAGGTACTTCTGAAAGC GCTACCCCGGAGTCCGGTCCAGGTACTTCTGAAAGCGCTCCGA AGGTAGCGCACCAGGTACTTCTGAAAGCGCAACCCCTGAATCC | 802 |

TABLE 37-continued

Exemplary GHXTEN comprising growth hormones, XTEN and cleavage sequences

| GHXTEN Name* | Amino Acid Sequence | SEQ ID NO: | DNA Nucleotide Sequence | SEQ ID NO: |
|---|---|---|---|---|
| | TSTEPSEGSAPGTSTE<br>PSEGSAPGTSESATP<br>ESGPGTSESATPESG<br>PGSPAGSPTSTEEGT<br>SESATPESGPGSEPA<br>TSGSETPGTSESATPE<br>SGPGTSTEPSEGSAP<br>GTSTEPSEGSAPGTS<br>TEPSEGSAPGTSTEPS<br>EGSAPGTSTEPSEGS<br>APGTSTEPSEGSAPG<br>SPAGSPTSTEEGTSTE<br>PSEGSAPGTSESATP<br>ESGPGSEPATSGSET<br>PGTSESATPESGPGS<br>EPATSGSETPGTSES<br>ATPESGPGTSTEPSE<br>GSAPGTSESATPESG<br>PGSPAGSPTSTEEGSP<br>AGSPTSTEEGSPAGS<br>PTSTEEGTSESATPES<br>GPGTSTEPSEGSAPG<br>TSESATPESGPGSEP<br>ATSGSETPGTSESAT<br>PESGPGSEPATSGSE<br>TPGTSESATPESGPG<br>TSTEPSEGSAPGSPA<br>GSPTSTEEGTSESATP<br>ESGPGSEPATSGSET<br>PGTSESATPESGPGSP<br>AGSPTSTEEGSPAGS<br>PTSTEEGTSTEPSEGS<br>APGTSESATPESGPG<br>TSESATPESGPGTSES<br>ATPESGPGSEPATSG<br>SETPGSEPATSGSETP<br>GSPAGSPTSTEEGTS<br>TEPSEGSAPGTSTEPS<br>EGSAPGSEPATSGSE<br>TPGTSESATPESGPG<br>TSTEPSEGSAPGFPTI<br>PLSRLFDNAMLRAH<br>RLHQLAFDTYQEFEE<br>AYIPKEQKYSFLQNP<br>QTSLCFSESIPTPSNR<br>EETQQKSNLELLRIS<br>LLLIQSWLEPVQFLR<br>SVFANSLVYGASDS<br>NVYDLLKDLEEGIQT<br>LMGRLEDGSPRTGQI<br>FKQTYSKFDTNSHN<br>DDALLKNYGLLYCF<br>RKDMDKVETFLRIV<br>QCRSVEGSCGFGGG<br>LGPVSGVPGGSEPAT<br>SGSETPGTSESATPES<br>GPGSEPATSGSETPG<br>SPAGSPTSTEEGTSTE<br>PSEGSAPGSEPATSG<br>SETPGSEPATSGSETP<br>GSEPATSGSETPGTS<br>TEPSEGSAPGTSESA<br>TPESGPGSEPATSGS<br>ETPGTSTEPSEGSAP | | GGTCCAGGTAGCGAACCGGCTACTTCTGGCTCTGAGACTCCAG<br>GTACTTCTACCGAACCGTCCGAAGGTAGCGCACCAGGTACTTCT<br>ACTGAACCGTCCGAAGGTAGCGCACCAGGTACTTCTGAAAGCG<br>CAACCCCGGAATCCGGCCCAGGTACCTCTGAAAGCGCAACCCC<br>GGAGTCCGGCCCAGGTAGCCCTGCTGGCTCTCCAACCTCCACCG<br>AAGAAGGTACCTCTGAAAGCGCAACCCCTGAATCCGGCCCAGG<br>TAGCGAACCGGCAACCTCCGGTTCTGAAACCCCAGGTACCTCT<br>GAAAGCGCTACTCCGGAGTCTGGCCCAGGTACCTCTACTGAAC<br>CGTCTGAGGGTAGCGCTCCAGGTACTTCTACTGAACCGTCCGAA<br>GGTAGCGCACCAGGTACTTCTACCGAACCGTCCGAAGGCAGCG<br>CTCCAGGTACCTCTACTGAACCTTCCGAGGGCAGCGCTCCAGGT<br>ACCTCTACCGAACCTTCTGAAGGTAGCGCACCAGGTACTTCTAC<br>CGAACCGTCCGAGGGTAGCGCACCAGGTAGCCCAGCAGGTTCT<br>CCTACCTCCACCGAGGAAGGTACTTCTACCGAACCGTCCGAGG<br>GTAGCGCACCAGGTACCTCTGAAAGCGCAACTCCTGAGTCTGG<br>CCCAGGTAGCGAACCTGCTACCTCCGGCTCTGAGACTCCAGGT<br>ACCTCTGAAAGCGCAACCCCGGAATCTGGTCCAGGTAGCGAAC<br>CTGCAACCTCTGGCTCTGAAACCCCAGGTACCTCTGAAAGCGCT<br>ACTCCTGAATCTGGCCCAGGTACTTCTACTGAACCGTCCGAGGG<br>CAGCGCACCAGGTACTTCTGAAAGCGCTACTCCTGAGTCCGGA<br>CCAGGTAGCCCGGCTGGCTCTCCGACTTCCACCGAGGAAGGTA<br>GCCCGGCTGGCTCTCCAACTTCTACTGAAGAAGGTAGCCCGGC<br>AGGCTCTCCGACCTCTACTGAGGAAGGTACTTCTGAAAGCGCA<br>ACCCCGGAGTCCGGCCCAGGTTCTGAGG<br>GCAGCGCACCAGGTACCTCTGAAAGCGCAACTCCTGAGTCTGG<br>CCCAGGTAGCGAACCTGCTACCTCCGGCTCTGAGACTCCAGGT<br>ACCTCTGAAAGCGCAACCCCGGAATCTGGTCCAGGTAGCGAAC<br>CTGCAACCTCTGGCTCTGAAACCCCAGGTACCTCTGAAAGCGCT<br>ACTCCTGAATCTGGCCCAGGTACTTCTACTGAACCGTCCGAGGG<br>CAGCGCACCAGGTAGCCCTGCTGGCTCTCCAACCTCCACCGAA<br>GAAGGTACTCTGAAAGCGCAACCCCTGAATCCGGCCCAGGTA<br>GCGAACCGGCAACCTCCGGTTCTGAAACCCCAGGTACTTCTGA<br>AAGCTACTCCTGAGTCCGGACCAGGTAGCCCGGCTGGCTCTC<br>CGACTTCCACCGAGGAAGGTAGCCCGGCTGGCTCTCCAACTTCT<br>ACTGAAGAAGGTACTTCTACCGAACCTTCCGAGGGCAGCGCAC<br>CAGGTACTTCTGAAAGCGCTACCCCTGAGTCCGGCCCAGGTACT<br>TCTGAAAGCGCTACTCCTGAATCCGGTCCAGGTACTTCTGAAAG<br>CGCTACCCCGAATCTGGCCCAGGTAGCGAACCGGCTACTTCT<br>GGTTCTGAAACCCCAGGTAGCGAACCGGCTACCTCCGGTTCTG<br>AAACTCCAGGTAGCCCAGCAGGCTCTCCGACTTCCACTGAGGA<br>AGGTACTTCTGAACCTTCTGAAGGCAGCGCACCAGGTAGC<br>CAACCTCTGGCTCTGAAACCCCAGGTACCTCTGAAAGCGCTACT<br>CCTGAATCTGGCCCAGGTACTTCTACTGAACCGTCCGAGGGCA<br>GCGCACCAGGTGTCTCGTCTGTTGAT<br>AATGCTATGCTGCGTGCGCACCGTCTGCACCAGCTGGCCTTTGA<br>TACTTACCAGGAATTTGAAGAAGCCTACATTCCTAAAGAGCAGA<br>AGTACTCTTTCCTGCAAAACCCACAGACTTCTCTCTGCTTCAGC<br>GAATCTATTCCGACGCCTTCCAATCGCGAGGAAACTCAGCAAA<br>AGTCCAATCTGGAACTACTCCGCATTTCTCTGCTTCTGATTCAG<br>AGCTGGCTAGAACCAGTGCAATTTCTGCGTTCCGTCTTCGCCAA<br>TAGCCTAGTTTATGGCGCATCCGACAGCAACGTATACGATCTCC<br>TGAAAGATCTCGAGGAAGGCATTCAGACCCTGATGGGTCGTCT<br>CGAGGATGGCTCTCCGCGTACTGGTCAGATCTTCAAGCAGACTT<br>ACTCTAAATTTGATACTAACAGCCACAATGACGATGCGCTTCTA<br>AAAAACTATGGTCTGCTGTATTGTTTTCGTAAAGATATGGACAA<br>AGTTGAAACCTTCCTGCGTATTGTTCAGTGTCGTTCCGTTGAGG<br>GCAGCTGTGGTTTCTAAGGTggcggcctgggcccggtgagcggcgtgccgGGT<br>GGTAGCGAACCGGCAACTTCCGGCTCTGAAACCCCAGGTACTT<br>CTGAAAGCGCTACTCCTGAGTCTGGCCCAGGTAGCGAACCTGC<br>TACCTCTGGCTCTGAAACCCCAGGTAGCCCCGGCAGGCTCTCCGA<br>CTTCCACCGAGGAAGGTACCTCTACTGAACCTTCTGAGGGTAGC<br>GCTCCAGGTAGCGAACCGGCAACCTCTGGCTCTGAAACCCCAG<br>GTAGCGAACCTGCTACCTCCGGCTCTGAAACTCCAGGTAGCGA<br>ACCGGCTACTTCCGGTTCTGAAACTCCAGGTACCTCTACCGAAC<br>CTTCCGAAAGCGCACCAGGTACTTCTGAAAGCGCAACCCCT<br>GAATCCGGTCCAGGTAGCGAACCGGCTACTTCTGGCTCTGAG<br>ACTCCAGGTACTTCTACCGAACCGTCCGAAGGTAGCGCACCA | |
| AE912-<br>hGH-<br>MMP-17-<br>AE144 | MAEPAGSPTSTEEGT<br>PGSGTASSSPGSSTPS<br>GATGSPGASPGTSST<br>GSPGSPAGSPTSTEE<br>GTSESATPESGPGTS<br>TEPSEGSAPGSPAGS | 803 | ATGGCTGAACCTGCTGGCTCTCCAACCTCCACTGAGGAAGGTA<br>CCCCGGGTAGCGGTACTGCTTCTTCCTCTCCAGGTAGCTCTACC<br>CCTTCTGGTGCAACCGGCTCTCCAGGTGCTTCTCCGGGCACCAG<br>CTCTACCGGTTCTCCAGGTAGCCCGGCTGGCTCTCCTACCTCTA<br>CTGAGGAAGGTACTTCTGAAAGCGCTACTCCTGAGTCTGGTCCA<br>GGTACCTCTACTGAACCGTCCGAAGGTAGCGCTCCAGGTAGCC | 804 |

TABLE 37-continued

Exemplary GHXTEN comprising growth hormones, XTEN and cleavage sequences

| GHXTEN Name* | Amino Acid Sequence | SEQ ID NO: | DNA Nucleotide Sequence | SEQ ID NO: |
|---|---|---|---|---|
| | PTSTEEGTSTEPSEGS | | CAGCAGGCTCTCCGACTTCCACTGAGGAAGGTACTTCTACTGAA | |
| | APGTSTEPSEGSAPG | | CCTTCCGAAGGCAGCGCACCAGGTACCTCTACTGAACCTTCTGA | |
| | TSESATPESGPGSEP | | GGGCAGCGCGCTCCAGGTACTTCTGAAAGCGCTACCCCGGAATCT | |
| | ATSGSETPGSEPATS | | GGCCCAGGTAGCGAACCGGCTACTTCTGGTTCTGAAACCCCAG | |
| | GSETPGSPAGSPTST | | GTAGCGAACCGGCTACCTCCGGTTCTGAAACTCAGGTAGCCC | |
| | EEGTSESATPESGPG | | GGCAGGCTCTCCGACCTCTACTGAGGAAGGTACTTCTGAAAGC | |
| | TSTEPSEGSAPGTSTE | | GCAACCCCGGAGTCCGGCCCAGGTACCTCTACCGAACCGTCTG | |
| | PSEGSAPGSPAGSPT | | AGGGCAGCGCACCAGGTACTTCTACCGAACCGTCCGAGGGTAG | |
| | STEEGTSTEPSEGSAP | | CGCACCAGGTAGCCCAGCAGGTTCTCCTACCTCCACCGAGGAA | |
| | GTSTEPSEGSAPGTS | | GGTACTTCTACCGAACCGTCCGAGGGTAGCGCACCAGGTACCT | |
| | ESATPESGPGTSTEPS | | CTACTGAACCTTCTGAGGGCAGCGCTCCAGGTACTTCTGAAAGC | |
| | EGSAPGTSESATTPES | | GCTACCCCGGAGTCCGGTCCAGGTACTTCTACTGAACCGTCCGA | |
| | GPGSEPATSGSETPG | | AGGTAGCGCACCAGGTACTTCTGAAAGCGCAACCCCTGAATCC | |
| | TSTEPSEGSAPGTSTE | | GGTCCAGGTAGCGAACCGGCTACTTCTGGCTCTGAGACTCCAG | |
| | PSEGSAPGTSESATP | | GTACTTCTACCGAACCGTCCGAAGGTAGCGCACCAGGTACTTCT | |
| | ESGPGTSESATPESG | | ACTGAACCGTCTGAAGGTAGCGCACCAGGTACTTCTGAAAGCG | |
| | PGSPAGSPTSTEEGT | | CAACCCCGGAATCCGGCCCAGGTACCTCTGAAAGCGCAACCCC | |
| | SESATPESGPGSEPA | | GGAGTCCGGCCCAGGTAGCCCTGCTGGCTCTCCAACCTCCACCG | |
| | TSGSETPGTSESATPE | | AAGAAGGTACCTCTGAAAGCGCAACCCCTGAATCCGGCCCAGG | |
| | SGPGTSTEPSEGSAP | | TAGCGAACCGGCTACCTCCGGTTCTGAAACCCCAGGTACCTCT | |
| | GTSTEPSEGSAPGTS | | GAAAGCGCTACTCCGGAGTCTGGCCCAGGTACCTCTACTGAAC | |
| | TEPSEGSAPGTSTEPS | | CGTCTGAGGGTAGCGCTCCAGGTACTTCTACTGAACCGTCCGAA | |
| | EGSAPGTSTEPSEGS | | GGTAGCGCACCAGGTACTTCTACCGAACCGTCCGAAGGCAGCG | |
| | APGTSTEPSEGSAPG | | CTCCAGGTACCTCTACTGAACCTTCCGAGGGCAGCGCTCCAGGT | |
| | SPAGSPTSTEEGTSTE | | ACCTCTACCGAACCTTCTGAAGGTAGCGCACCAGGTACTTCTAC | |
| | PSEGSAPGTSESATP | | CGAACCGTCCGAGGGTAGCGCACCAGGTAGCCCAGCAGGTTCT | |
| | ESGPGSEPATSGSET | | CCTACCTCCACCGAGGAAGGTACTTCTACCGAACCGTCCGAGG | |
| | PGTSESATPESGPGS | | GTAGCGCACCAGGTACCTCTGAAAGCGCAACCTCCTGAGTCTGG | |
| | EPATSGSETPGTSES | | CCCAGGTAGCGAACCTGCTACCTCCGGCTCTGAGACTCCAGGT | |
| | ATPESGPGTSTEPSE | | ACCTCTGAAAGCGCAACCCCGGAATCTGGTCCAGGTAGCGAAC | |
| | GSAPGTSESATPESG | | CTGCAACCTCTGGCTCTGAAACCCCAGGTACCTCTGAAAGCGCT | |
| | PGSPAGSPTSTEEGSP | | ACTCCTGAATCTGGCCCAGGTACTTCTACTGAACCGTCCGAGGG | |
| | AGSPTSTEEGSPAGS | | CAGCGCACCAGGTACTTCTGAAAGCGCTACTCCTGAGTCCGGCG | |
| | PTSTEEGTSESATPES | | CCAGGTAGCCCGGCTGGCTCTCCGACTTCCACCGAGGAAGGTA | |
| | GPGTSTEPSEGSAPG | | GCCCGGCTGGCTCTCCAACTTCTACTGAAGAAGGTAGCCCGGC | |
| | TSESATPESGPGSEP | | AGGCTCTCCGACCTCTACTGAGGAAGGTACTTCTGAAAGCGCA | |
| | ATSGSETPGTSESAT | | ACCCCGGAGTCCGGCCCAGGTACCTCTACCGAACCGTCTGAGG | |
| | PESGPGSEPATSGSE | | GCAGCGCACCAGGTACCTCTGAAAGCGCAACCTCCTGAGTCTGG | |
| | TPGTSESATPESGPG | | CCCAGGTAGCGAACCTGCTACCTCCGGCTCTGAGACTCCAGGT | |
| | TSTEPSEGSAPGSPA | | ACCTCTGAAAGCGCAACCCCCGGAATCTGGTCCAGGTAGCGAAC | |
| | GSPTSTEEGTSESATP | | CTGCAACCTCTGGCTCTGAAACCCCAGGTACCTCTGAAAGCGCT | |
| | ESGPGSEPATSGSET | | ACTCCTGAATCTGGCCCAGGTACTTCTACTGAACCGTCCGAGGG | |
| | PGTSESATPESGPSP | | CAGCGCACCAGGTAGCCCTGCTGGCTCTCCAACCTCCACCGAA | |
| | AGSPTSTEEGSPAGS | | GAAGGTACTCTGAAAGCGCAACCCCTGAATCCGGCCCAGGTA | |
| | PTSTEEGTSTEPSEGS | | GCGAACCGGCTACCTCCGGTTCTGAAACCCCAGGTACTTCTGA | |
| | APGTSESATPESGPG | | AAGCGCTACTCCTGAGTCCGGCCCAGGTAGCCCGGCTGGCTCTC | |
| | TSESATPESGPGTSES | | CGACTTCCACCGAGGAAGGTAGCCCGGCTGGCTCTCCAACTTCT | |
| | ATPESGPGSEPATSG | | ACTGAAGAAGGTACTTCTACCGAACCTTCCGAGGGCAGCGCAC | |
| | SETPGSEPATSGSETP | | CAGGTACTTCTGAAAGCGCTACCCCTGAGTCCGGCCCAGGTTCT | |
| | GSPAGSPTSTEEGTS | | TCTGAAAGCGCTACTCCTGAATCCGGTCCAGGTACTTCTGAAAG | |
| | TEPSEGSAPGTSTEPS | | CGCTACCCCGGAATCTGGCCCAGGTAGCGAACCGGCTACTTCT | |
| | EGSAPGSEPATSGSE | | GGTTCTGAAACCCCAGGTAGCGAACCGGCTACCTCCGGTTCTG | |
| | TPGTSESATPESGPG | | AAACTCCAGGTAGCGCCAGCAGGCTCTCCGACTTCCACTGAGGA | |
| | TSTEPSEGSAPGFPTI | | AGGTACTTCTACTGAACCTTCCGAAGGCAGCGCACCAGGTACC | |
| | PLSRLFDNAMLRAH | | TCTACTGAACCTTCTGAGGGCAGCGCTCCAGGTAGCGAACCTG | |
| | RLHQLAFDTYQEFEE | | CAACCTCTGGCTCTGAAACCCCAGGTACCTCTGAAAGCGCTACT | |
| | AYIPKEQKYSFLQNP | | CCTGAATCTGGCCCAGGTACTTCTACTGAACCGTCCGAGGGGT | |
| | QTSLCFSESIPTPSNR | | GCGCACCAGGTTTCCGACTATTCCGCTGTCTCGTCTGTTTGAT | |
| | EETQQKSNLELLRIS | | AATGCTATGCTGCGTGCGCACCGTCTGCACCAGCTGGCCTTTGA | |
| | LLLIQSWLEPVQFLR | | TACTTACCAGGAATTTGAAGAAGCCTACATTCCTAAAGAGCAGA | |
| | SVFANSLVYGASDS | | AGTACTCTTTCCTGCAAAACCCACAGACTTCTCTCTGCTTCAGC | |
| | NVYDLLKDLEEGIQT | | GAATCTATTCCGACGCCTTCCAATCGCGAGGAAACTCAGCAAA | |
| | LMGRLEDGSPRTGQI | | AGTCCAATCTGGAACTACTCCGCATTTCTCTGCTTCTGATTCAG | |
| | FKQTYSKFDTNSHN | | AGCTGGCTAGAACCAGTGCAATTTCTGCGTTCCGTCTTCGCCAA | |
| | DDALLKNYGLLYCF | | TAGCCTAGTTTATGGCGCATCCGACAGCAACGTATACGATCTCC | |
| | RKDMDKVETFLRIV | | TGAAAGATCTGGAGGAAGGCATTCAGACCCTGATGGGTCGTCT | |
| | QCRSVEGSCGFGAPL | | CGAGGATGGCTCTCCGCGTACTGGTCAGATCTTCAAGCAGACTT | |
| | GLRLRGGGGSEPATS | | ACTCTAAATTTGATACTAACAGCCACAATGACGATGCGTTCTA | |
| | GSETPGTSESATPES | | AAAAACTATGGTCTGCTGTATTGTTTCGTAAAGATATGGACAAA | |
| | GPGSEPATSGSETPG | | AGTTGAAACCTTCCTGCGTATTGTCAGTGTCGTTCCGTTGAGG | |
| | SPAGSPTSTEEGTSTE | | GCAGCTGTGGTTTCTAAGGTgcgccgctgggcctgcgcctgcgcggcggcGGTG | |
| | PSEGSAPGSEPATSG | | GTAGCGAACCGGCAACTTCCGGCTCTGAAACCCCAGGTACTTCT | |
| | SETPGSEPATSGSETP | | GAAAGCGCTACTCCTGAGTCTGGCCCAGGTAGCGAACCTGCTA | |
| | GSEPATSGSETPGTS | | CCTCTGGCTCTGAAACCCCAGGTAGCCCCGGCAGGCTCTCCGACT | |
| | TEPSEGSAPGTSESA | | TCCACCGAGGAAGGTACCTCTACTGAACCTTCTGAGGGTAGCG | |

TABLE 37-continued

Exemplary GHXTEN comprising growth hormones, XTEN and cleavage sequences

| GHXTEN Name* | Amino Acid Sequence | SEQ ID NO: | DNA Nucleotide Sequence | SEQ ID NO: |
|---|---|---|---|---|
| | TPESGPGSEPATSGS ETPGTSTEPSEGSAP | | CTCCAGGTAGCGAACCGGCAACCTCTGGCTCTGAAACCCCAGG TAGCGAACCTGCTACCTCCGGCTCTGAAACTCCAGGTAGCGAA CCGGCTACTTCCGGTTCTGAAACTCCAGGTACCTCTACCGAACC TTCCGAAGGCAGCGCACCAGGTACTTCTGAAAGCGCAACCCCT GAATCCGGTCCAGGTAGCGAACCGGCTACTTCTGGCTCTGAGA CTCCAGGTACTTCTACCGAACCGTCCGAAGGTAGCGCACCA | |
| AE912-hGH-Thrombin-AE288 | MAEPAGSPTSTEEGT PGSGTASSSPGSSTPS GATGSPGASPGTSST GSPGSPAGSPTSTEE GTSESATPESGPGTS TEPSEGSAPGSPAGS PTSTEEGTSTEPSEGS APGTSTEPSEGSAPG TSESATPESGPGSEP ATSGSETPGSEPATS GSETPGSPAGSPTST EEGTSESATPESGPG TSTEPSEGSAPGTSTE PSEGSAPGSPAGSPT STEEGTSTEPSEGSAP GTSTEPSEGSAPGTS ESATPESGPGTSTEPS EGSAPGTSESATPES GPGSEPATSGSETPG TSTEPSEGSAPGTSTE PSEGSAPGTSESATP ESGPGTSESATPESG PGSPAGSPTSTEEGT SESATPESGPGSEPA TSGSETPGTSESATPE SGPGTSTEPSEGSAP GTSTEPSEGSAPGTS TEPSEGSAPGTSTEPS EGSAPGTSTEPSEGS APGTSTEPSEGSAPG SPAGSPTSTEEGTSTE PSEGSAPGTSESATP ESGPGSEPATSGSET PGTSESATPESGPGS EPATSGSETPGTSES ATPESGPGTSTEPSE GSAPGTSESATPESG PGSPAGSPTSTEEGSP AGSPTSTEEGSPAGS PTSTEEGTSESATPES GPGTSTEPSEGSAPG TSESATPESGPGSEP ATSGSETPGTSESAT PESGPGSEPATSGSE TPGTSESATPESGPG TSTEPSEGSAPGSPA GSPTSTEEGTSESATP ESGPGSEPATSGSET PGTSESATPESGPSP AGSPTSTEEGSPAGS PTSTEEGTSTEPSEGS APGTSESATPESGPG TSESATPESGPGTSES ATPESGPGSEPATSG SETPGSEPATSGSETP GSPAGSPTSTEEGTS TEPSEGSAPGTSTEPS EGSAPGSPAGSPTST EEGTSESATPESGPG TPGTSESATPESGPG TSTEPSEGSAPGFPTI PLSRLFDNAMLRAH RLHQLAFDTYQEFEE AYIPKEQKYSFLQNP QTSLCFSESIPTPSNR EETQQKSNLELLRIS LLLIQSWLEPVQFLR SVFANSLVYGASDS NVYDLLKDLEEGIQT | 805 | ATGGCTGAACCTGCTGGCTCTCCAACCTCCACTGAGGAAGGTA CCCCGGGTAGCGGTACTGCTTCTTCCTCTCCAGGTAGCTCTACC CCTTCTGGTGCAACCGGCTCTCCAGGTGCTTCTCCGGGCACCAG CTCTACCGGTTCTCCAGGTAGCCCGGCTGGCTCTCCTACCTCTA CTGAGGAAGGTACTTCTGAAAGCGCTACTCCTGAGTCTGGTCCA GGTACCTCTACTGAACCGTCCGAAGGTAGCGCTCCAGGTAGCC CAGCAGGCTCTCCGACTTCCACTGAGGAAGGTACTTCTACTGAA CCTTCCGAAGGCAGCGCACCAGGTACCTCTACTGAACCTTCTGA GGGCGCGCTCCAGGTACTTCTGAAAGCGCTACCCCGGAATCT GGCCCAGGTAGCGAACCGGCTACTTCTGGTTCTGAAACCCCAG GTAGCGAACCGGCTACCTCCGGTTCTGAAACTCCAGGTAGCCC GGCAGGCTCTCCGACCTCTACTGAGGAAGGTACTTCTGAAAGC GCAACCCCGGAATCCGGCCCAGGTACTTCTACCGAACCGTCTG AGGGCAGCGCACCAGGTACTTCTACCGAACCGTCCGAGGGTAG CGCACCAGGTAGCCCAGCAGGTTCTCCTACCTCCACCGAGGAA GGTACTTCTACCGAACCGTCCGAGGGTAGCGCACCAGGTACCT CTACTGAACCTTCTGAGGGCAGCGCTCCAGGTACTTCTGAAAGC GCTACCCCGGAGTCCGGTCCAGGTACTTCTACTGAACCGTCCGA AGGTAGCGCACCAGGTACTTCTGAAAGCGCAACCCCTGAATCC GGTCCAGGTAGCGAACCGGCTACTTCTGGCTCTGAGACTCCAG GTACTTCTACCGAACCGTCCGAAGGTAGCGCACCAGGTACTTCT ACTGAACCGTCTGAAGGTAGCGCACCAGGTACTTCTGAAAGCG CAACCCCGGAATCCGGCCCAGGTACCTCTGAAAGCGCAACCCC GGAGTCCGCCCAGGTAGCCCTGCTGGCTCTCCAACCTCCACCG AAGAAGGTACTTCTGAAAGCGCAACCCCTGAATCGGCCCAGG TAGCGAACCGGCTACCTCCGGTTCTGAAACCCCAGGTACCTCT GAAAGCGCTACTCCGGAGTCTGGCCCAGGTACCTCTACTGAAC CGTCTGAGGGTAGCGCTCCAGGTACTTCTACTGAACCGTCCGAA GGTAGCGCACCAGGTACTTCTACCGAACCGTCCGAAGGCAGCG CTCCAGGTACCTCTACTGAACCGTCCGAGGGCAGCGCTCCAGGT ACCTCTACCGAACCTTCTGAAGGTAGCGCACCAGGTACTTCTAC CGAACCGTCCGAGGGTAGCGCACCAGGTAGCCCAGCAGGTTCT CCTACCTCCACCGAGGAAGGTACTTCTACCGAACCGTCCGAGG GTAGCGCACCAGGTACTTCTGAAAGCGCAACCCCTGAGTCTGG CCCAGGTAGCGAACCTGCTACCTCCGGCTCTGAGACTCCAGGT ACCTCTGAAAGCGCAACCCCGGAATCTGGTCCAGGTAGCGAAC CTGCAACCTCTGGCTCTGAAACCCCAGGTACCTCTGAAAGCGCT ACTCCTGAATCTGGCCCAGGTACTTCTACTGAACCGTCCGAGGG CAGCGCACCAGGTAGCCCTGCTGGCTCTCCAACCTCCACCGAA GAAGGTACTCTGAAAGCGCAACCCCTGAATCCGGCCCAGGTA GCGAACCGGCAACCTCCGGTTCTGAAACCCCAGGTACTTCTGA AAGCGCTACTCCTGAGTCTGGCCCAGGTAGCCCGGCTGGCTCTC CGACTTCCACCGAGGAAGGTAGCCCGGCTGGCTCTCCAACTTCT ACTGAAGAAGGTACTTCTACCGAACCTTCCGAGGGCAGCGCAC CAGGTACTTCTGAAAGCGCTACCCCTGAGTCCGGCCAGGTACT TCTGAAAGCGCTACTCCTGAATCCGGTCCAGGTACTTCTGAAAG CGCTACCCCGGAATCTGGCCCAGGTAGCGAACCGGCTACTTCT GGTTCTGAAACCCCAGGTAGCGAACCGGCTACCTCCGGTTCTG AAACTCCAGGTAGCGAACCAGGCTCTCCGACTTCCACTGAGGA AGGTACTTCTACTGAACCTTCCGAAGGCAGCGCACCAGGTACC TCTACTGAACCTTCTGAGGGCAGCGCTCCAGGTAGCGAACCTG CAACCTCTGGCTCTGAAACCCCAGGTACCTCTGAAAGCGCTACT CCTGAATCCGGCCCAGGTACTTCTGAAACCGTCCGAGGGCAGC GCGACCAGGTTTTCCGACTATTCCGCTGTCTCGTCTGTTTGAT AATGCTATGCTGCGTGCGCACCGTCTGCACCAGCTGGCCTTTGA TACTTACCAGGAATTTGAAGAAGCCTACATTCCTAAAGAGCAGA AGTACTCTTTCCTGCAAAACCCACAGACTTCTCTCTGCTTCAGC GAATCTATTCCGACGCCTTCCAATCGCGAGGAAACTCAGCAAA | 806 |

TABLE 37-continued

Exemplary GHXTEN comprising growth hormones, XTEN and cleavage sequences

| GHXTEN Name* | Amino Acid Sequence | SEQ ID NO: | DNA Nucleotide Sequence | SEQ ID NO: |
|---|---|---|---|---|
| | LMGRLEDGSPRTGQI FKQTYSKFDTNSHN DDALLKNYGLLYCF RKDMDKVETFLRIV QCRSVEGSCGFGLTP RSLLVGGGGTSESAT PESGPGSEPATSGSE TPGTSESATPESGPG SEPATSGSETPGTSES ATPESGPGTSTEPSE GSAPGSPAGSPTSTE EGTSESATPESGPGS EPATSGSETPGTSES ATPESGPGSPAGSPT STEEGSPAGSPTSTEE GTSTEPSEGSAPGTS ESATPESGPGTSESA TPESGPGTSESATPES GPGSEPATSGSETPG SEPATSGSETPGSPA GSPTSTEEGTSTEPSE GSAPGTSTEPSEGSA PGSEPATSGSETPGT SESATPESGPGTSTEP SEGSAP | | AGTCCAATCTGGAACTACTCCGCATTTCTCTGCTTCTGATTCAG AGCTGGCTAGAACCAGTGCAATTTCTGCGTTCCGTCTTCGCCAA TAGCCTAGTTTATGCGCATCCGACAGCAACGTATACGATCTCC TGAAAGATCTCGAGGAAGGCATTCAGACCCTGATGGGTCGTCT CGAGGATGGCTCTCCGCGTACTGGTCAGATCTTCAAGCAGACTT ACTCTAAATTTGATACTAACAGCCACAATGACGATGCGCTTCTA AAAAACTATGGTCTGCTGTATTGTTTTCGTAAAGATATGGACAA AGTTGAAACCTTCCTGCGTATTGTTCAGTGTCGTTCCGTTGAGG GCAGCTGTGGTTTCTAAGGTctgaccccgcgcagcctgctggtgggcggcGGTG GTACCTCTGAAAGCGCAACTCCTGAGTCTGGCCCAGGTAGCGA ACCTGCTACCTCCGGCTCTGAGACTCCAGGTACCTCTGAAAGCG CAACCCCGGAAGTCTGGTCCAGGTAGCGAACCTGCAACCTCTGG CTCTGAAACCCCAGGTACCTCTGAAAGCGCTACTCCTGAATCTG GCCCAGGTACTTCTACTGAACCGTCCGAGGGCAGCGCACCAGG TAGCCCTGCTGGCTCTCCAACCTCCACCGAAGAAGGTACCTCTG AAAGCGCAACCCCTGAATCCGGCCCAGGTAGCGAACCGGCAAC CTCCGGTTCTGAAACCCCAGGTACTTCTGAAAGCGCTACTCCTG AGTCCGGCCCAGGTAGCCCGGCTGGCTCTCCGACTTCCACCGA GGAAGGTAGCCCGGCTGGCTCTCCAACTTCTACTGAAGAAGGT ACTTCTACCGAACCTTCCGAGGGCAGCGCACCAGGTACTTCTGA AAGCGCTACCCCTGAGTCCGGCCCAGGTACTTCTGAAAGCGCT ACTCCTGAATCCGGTCCAGGTACTTCTGAAAGCGCTACCCCGGA ATCTGGCCCAGGTAGCGAACCGGCTACTTCTGGTTCTGAAACCC CAGGTAGCGAACCGGCTACCTCCGGTTCTGAAACTCCAGGTAG CCCAGCAGGCTCTCCGACTTCCACTGAGGAAGGTACTTCTACTG AACCTTCCGAAGGCAGCGCACCAGGTACCTCTACTGAACCTTCT GAGGGCAGCGCTCCAGGTAGCGAACCTGCAACCTCTGGCTCTG AAACCCCAGGTACCTCTGAAAGCGCTACTCCTGAATCTGGCCC AGGTACTTCTACTGAACCGTCCGAGGGCAGCGCACCA | |
| AE912-hGH-FXIa-AE288 | MAEPAGSPTSTEEGT PGSGTASSSPGSSTPS GATGSPGASPGTSST GSPGSPAGSPTSTEE GTSESATPESGPGTS TEPSESGSAPGSPAGS PTSTEEGTSTEPSEGS APGTSTEPSEGSAPG TSESATPESGPGSEP ATSGSETPGSEPATS GSETPGSPAGSPTST EEGTSESATPESGPG TSTEPSEGSAPGTSTE PSEGSAPGSPAGSPT STEEGTSTEPSEGSAP GTSTEPSEGSAPGTS ESATPESGPGTSTEPS EGSAPGTSESATPES GPGSEPATSGSETPG TSTEPSEGSAPGTSTE PSEGSAPGTSESATP ESGPGTSESATPESG PGSPAGSPTSTEEGT SESATPESGPGSEPA TSGSETPGTSESATPE SGPGTSTEPSEGSAP GTSTEPSEGSAPGTS TEPSEGSAPGTSTEPS EGSAPGTSTEPSEGS APGTSTEPSEGSAPG SPAGSPTSTEEGTSTE PSEGSAPGTSESATP ESGPGSEPATSGSET PGTSESATPESGPGS EPATSGSETPGTSES ATPESGPGTSTEPSE GSAPGTSESATPESG PGSPAGSPTSTEEGSP AGSPTSTEEGSPAGS PTSTEEGTSESATPES GPGTSTEPSEGSAPG TSESATPESGPGSEP ATSGSETPGTSESAT PESGPGSEPATSGSE TPGTSESATPESGPG | 807 | ATGGCTGAACCTGCTGGCTCTCCAACCTCCACTGAGGAAGGTA CCCCGGGTAGCGGTACTGCTTCTTCCTCTCCAGGTAGCTCTACC CCTTCTGGTGCAACCGGCTCTCCAGGTGCTTCTCCGGGCACCAG CTCTACCGGTTCTCCAGGTAGCCCTGGCTCTCCTACCTCTA CTGAGGAAGGTACTTCTGAAAGCGCTACTCCTGAGTCTGGTCCA GGTACCTCTACTGAACCGTCCGAAGGTAGCGCTCCAGGTAGCC CAGCAGGCTCTCCGACTTCCACTGAGGAAGGTACTTCTACTGAA CCTTCCGAAGGCAGCGCACCAGGTACCTCTACTGAACCTTCTGA GGGCAGCGCTCCAGGTACTTCTGAAAGCGCTACCCCGGAATCT GGCCCAGGTAGCGAACCGGCTACTTCTGGTTCTGAAACCCCAG GTAGCGAACCGGCTACCTCCGGTTCTGAAACTCCAGGTAGCCC GGCAGGCTCTCCGACCTCTACTGAGGAAGGTACTTCTGAAAGC GCAACCCCGGAGTCCGGCCCAGGTACCTCTACCGAACCGTCTG AGGGCAGCGCACCAGGTACTTCTACCGAACCGTCCGAGGGTAG CGCACCAGGTAGCCCAGCAGGTTCTCCTACCTCCACCGAGGAA GGTACTTCTACCGAACCGTCCGAGGGTAGCGCACCAGGTACCT CTACTGAACCTTCTGAGGGCAGCGCTCCAGGTACTTCTGAAAGC GCTACCCCGGAGTCCGGTCCAGGTACTTCTACTGAACCGTCCGA AGGTAGCGCACCAGGTACTTCTGAAAGCGCAACCCCTGAATCC GGTCCAGGTAGCGAACCGGCTACTTCTGGCTCTGAGACTCCAG GTACTTCTACCGAACCGTCCGAAGGTAGCGCACCAGGTACTTCT ACTGAACCGTCTGAAGGTAGCGCACCAGGTACTTCTGAAAGCG CAACCCCGGAATCCGGCCCAGGTACCTCTGAAAGCGCAACCCT GGAGTCCGGCCCAGGTAGCCCTGCTGGCTCTCCAACCTCCACCG AAGAAGGTACCTCTGAAAGCGCAACCCCTGAATCCGGCCCAGG TAGCGAACCGGCAACCTCCGGTTCTGAAACCCCAGGTACCTCT GAAAGCGCTACTCCGGAGTCTGGCCCAGGTACCTCTACTGAAC CGTCTGAGGGTAGCGCTCCAGGTACTTCTACTGAACCGTCCGAA GGTAGCGCACCAGGTACTTCTACCGAACCGTCCGAAGGCAGCG CTCCAGGTACCTCTACTGAACCTTCCGAGGGCAGCGCTCCAGGT ACCTCTACCGAACCTTCTGAAGGTAGCGCACCAGGTACTTCTAC CGAACCGTCCGAGGGTAGCGCCAGGTAGCCCAGGCTTCT CCTACCTCCACCGAGGAAGGTACTTCTACCGAACCGTCCGAGG GTAGCGCACCAGGTACCTCTGAAAGCGCAACTCCTGAGTCTGG CCCAGGTAGCGAACCTGCTACCTCCGGCTCTGAGACTCCAGGT ACCTCTGAAAGCGCAACCCTGAATCCGGTCCAGGTAGCGAAC CTGCAACCTCTGGCTCTGAAACCCCAGGTACCTCTGAAAGCGCT ACTCCTGAATCTGGCCCAGGTACTTCTACTGAACCGTCCGAGGG CAGCGCACCAGGTACTTCTGAAAGCGCTACTCCTGAGTCCGGC CCAGGTAGCCCGGCTGGCTCTCCGACTTCCACCGAGGAAGGTA GCCCGGCTGGCTCTCCAACTTCTACTGAAGAAGGTAGCCCGGC AGGCTCTCCGACTTCTACTGAGGAAGGTACTTCTGAAAGCGCA ACCCCGGAGTCCGGCCCAGGTACCTCTACCGAACCGTCTGAGG GCAGCGCACCAGGTACCTCTGAAAGCGCAACTCCTGAGTCTGG CCCAGGTAGCGAACCTGCTACCTCCGGCTCTGAGACTCCAGGT | 808 |

TABLE 37-continued

Exemplary GHXTEN comprising growth hormones, XTEN and cleavage sequences

| GHXTEN Name* | Amino Acid Sequence | SEQ ID NO: | DNA Nucleotide Sequence | SEQ ID NO: |
|---|---|---|---|---|
| | TSTEPSEGSAPGSPA<br>GSPTSTEEGTSESATP<br>ESGPGSEPATSGSET<br>PGTSESATPESGPGSP<br>AGSPTSTEEGSPAGS<br>PTSTEEGTSTEPSEGS<br>APGTSESATPESGPG<br>TSESATPESGPGTSES<br>ATPESGPGSEPATSG<br>SETPGSEPATSGSETP<br>GSPAGSPTSTEEGTS<br>TEPSEGSAPGTSTEPS<br>EGSAPGSEPATSGSE<br>TPGTSESATPESGPG<br>TSTEPSEGSAPGFPTI<br>PLSRLFDNAMLRAH<br>RLHQLAFDTYQEFEE<br>AYIPKEQKYSFLQNP<br>QTSLCFSESIPTPSNR<br>EETQQKSNLELLRIS<br>LLLIQSWLEPVQFLR<br>SVFANSLVYGASDS<br>NVYDLLKDLEEGIQT<br>LMGRLEDGSPRTGQI<br>FKQTYSKFDTNSHN<br>DDALLKNYGLLYCF<br>RKDMDKVETFLRIV<br>QCRSVEGSCGFGGG<br>KLTRVVGGGGTSES<br>ATPESGPGSEPATSG<br>SETPGTSESATPESGP<br>GSEPATSGSETPGTS<br>ESATPESGPGTSTEPS<br>EGSAPGSPAGSPTST<br>EEGTSESATPESGPG<br>SEPATSGSETPGTSES<br>ATPESGPGSPAGSPT<br>STEEGSPAGSPTSTEE<br>GTSTEPSEGSAPGTS<br>ESATPESGPGTSESA<br>TPESGPGSTSESATPES<br>GPGSEPATSGSETPG<br>SEPATSGSETPGSPA<br>GSPTSTEEGTSTEPSE<br>GSAPGTSTEPSEGSA<br>PGSEPATSGSETPGT<br>SESATPESGPGTSTEP<br>SEGSAP | | ACCTCTGAAAGCGCAACCCCGGAATCTGGTCCAGGTAGCGAAC<br>CTGCAACCTCTGGCTCTGAAACCCCAGGTACCTCTGAAAGCGCT<br>ACTCCTGAATCTGGCCCAGGTACTTCTACTGAACCGTCCGAGGG<br>CAGCGCACCAGGTAGCCCTGCTGGCTCTCCAACCTCCACCGAA<br>GAAGGTACTTCTGAAAGCGCAACCCCTGAATCCGGCCCAGGTA<br>GCGAACCGGCAACCTCCGGTTCTGAAACCCCAGGTACTTCTGA<br>AAGCGCTACTCCTGAGTCCGGCCCAGGTAGCCCGGCTGGCTCTC<br>CGACTTCCACCGAGGAAGGTAGCCCGGCTGGCTCTCCAACTTCT<br>ACTGAAGAAGGTACTTCTACCGAACCTTCCGAGGGCAGCGCAC<br>CAGGTACTTCTGAAAGCGCTACCCCTGAGTCCGGCCCAGGTACT<br>TCTGAAAGCGCTACTCCTGAATCCGGTCCAGGTACTTCTGAAAG<br>CGCTACCCCCGGAATCTGGCCCAGGTAGCGAACCGGCTACTTCT<br>GGTTCTGAAACCCCAGGTAGCGAACCGGCTACCTCCGGTTCTG<br>AAACTCCAGGTAGCCCAGCAGGCTCTCCGACTTCCACTGAGGA<br>AGGTACTTCTACTGAACCTTCCGAAGGCAGCGCACCAGGTACC<br>TCTACTGAACCTTCTGAGGGCAGCGCTCCAGGTAGCGAACCTG<br>CAACCTCTGGCTCTGAAACCCCAGGTACCTCTGAAAGCGCTACT<br>CCTGAATCTGGCCCAGGTACTTCTACTGAACCGTCCGAGGGCA<br>GCGCACCAGGTTTTCCGACTATTCCGCTGTCTCGTCTGTTTGAT<br>AATGCTATGCTGCGTGCGCACCGTCTGCACCAGCTGGCCTTTGA<br>TACTTACCAGGAATTTGAAGAAGCcTACATTCCTAAAGAGCAGA<br>AGTACTCTTTCCTGCAAAACCCACAGACTTCTCTCTGCTTCAGC<br>GAATCTATTCCGACGCCTTCCAATCGCGAGGAAACTCAGCAAA<br>AGTCCAATCTGGAACTACTCCGCATTTCTCTGCTTCTGATTCAG<br>AGCTGGCTAGAACCAGTGCAATTTCTGCGTTCCGTCTTCGCCAA<br>TAGCCTAGTTTATGGCGCATCCGACAGCAACGTATACGATCTCC<br>TGAAAGATCTCGAGGAAGGCATTCAGACCCTGATGGGTCGTCT<br>CGAGGATGGCTCTCCGCGTACTGGTCAGATCTTCAAGCAGACTT<br>ACTCTAAATTTGATACTAACAGCCACAATGACGATGCGCTTCTA<br>AAAAACTATGGTCTGCTGTATTGTTTTCGTAAAGATATGGACAA<br>AGTTGAAACCTTCCTGCGTATTGTTCAGTGTCGTTCCGTTGAGG<br>GCAGCTGTGGTTTCTAAGGTggcggcaaactgacccgcgtggtgggcggcGGTG<br>GTACCTCTGAAAGCGCAACTCCTGAGTCTGGCCCAGGTAGCGA<br>ACCTGCTACCTCCGGCTCTGAGACTCCAGGTACCTCTGAAAGCG<br>CAACCCCGGAATCTGGTCCAGGTAGCGAACCTGCAACCTCTGG<br>CTCTGAAACCCCAGGTACCTCTGAAAGCGCTACTCCTGAATCTG<br>GCCCAGGTACTTCTACTGAACCGTCCGAGGGCAGCGCACCAGG<br>TAGCCCTGCTGGCTCTCCAACCTCCACCGAAGAAGGTACCTCTG<br>AAAGCGCAACCCCTGAATCCGGCCCAGGTAGCGAACCGGCAAC<br>CTCCGGTTCTGAAACCCCAGGTACTTCTGAAAGCGCTACTCCTG<br>AGTCCGGCCCAGGTAGCCCGGCTGGCTCTCCGACTTCCACCGA<br>GGAAGGTAGCCCGGCTGGCTCTCCAACTTCTACTGAAGAAGGT<br>ACTTCTACCGAACCTTCCGAGGGCAGCGCACCAGGTACTTCTGA<br>AAGCGCTACCCCTGAGTCCGGCCCAGGTACTTCTGAAAGCGCT<br>ACTCCTGAATCCGGTCCAGGTACTTCTGAAAGCGCTACCCCGGA<br>ATCTGGCCCAGGTAGCGAACCGGCTACTTCTGGTTCTGAAACCC<br>CAGGTAGCGAACCGGCTACCTCCGGTTCTGAAACTCCAGGTAG<br>CCCAGCAGGCTCTCCGACTTCCACTGAGGAAGGTACTTCTACTG<br>AACCTTCCGAAGGCAGCGCACCAGGTACCTCTACTGAACCTTCT<br>GAGGGCAGCGCTCCAGGTAGCGAACCTGCAACCTCTGGCTCTG<br>AAACCCCAGGTACCTCTGAAAGCGCTACTCCTGAATCTGGCCC<br>AGGTACTTCTACTGAACCGTCCGAGGGCAGCGCACCA | |
| AE912-<br>hGH-<br>Elastase-<br>AE288 | MAEPAGSPTSTEEGT<br>PGSGTASSSPGSSTPS<br>GATGSPGASPGTSST<br>GSPGSPAGSPTSTEE<br>GTSESATPESGPGTS<br>TEPSEGSAPGSPAGS<br>PTSTEEGTSTEPSEGS<br>APGTSTEPSEGSAPG<br>TSESATPESGPGSEP<br>ATSGSETPGSEPATS<br>GSETPGSPAGSPTST<br>EEGTSESATPESGPG<br>TSTEPSEGSAPGTSTE<br>PSEGSAPGSPAGSPT<br>STEEGTSTEPSEGSAP<br>GTSTEPSEGSAPGTS<br>ESATPESGPGTSTEPS<br>EGSAPGTSESATPES<br>GPGSEPATSGSETPG<br>TSTEPSEGSAPGTSTE<br>PSEGSAPGTSESATP<br>ESGPGTSESATPESG | 809 | ATGGCTGAACCTGCTGGCTCTCCAACCTCCACTGAGGAAGGTA<br>CCCCGGGTAGCGGTACTGCTTCTTCCTCTCCAGGTAGCTCTACC<br>CCTTCTGGTGCAACCGGCTCTCCAGGTGCTTCTCCGGGCACCAG<br>CTCTACCGGTTCTCCAGGTAGCCCGGCTGGCTCTCCTACCTCTA<br>CTGAGGAAGGTACTTCTGAAAGCGCTACTCCTGAGTCTGGTCCA<br>GGTACCTCTACTGAACCGTCCGAAGGTAGCGCTCCAGGTAGCC<br>CAGCAGGCTCTCCGACTTCCACTGAGGAAGGTACTTCTACTGAA<br>CCTTCCGAAGGCAGCGCACCAGGTACCTCTACTGAACCTTCTGA<br>GGGCAGCGCTCCAGGTACTTCTGAAAGCGCTACCCCGGAATCT<br>GGCCCAGGTAGCGAACCGGCTACTTCTGGTTCTGAAACCCCAG<br>GTAGCGAACCGGCTACCTCCGGTTCTGAAACTCCAGGTAGCCC<br>AGCAGGCTCTCCGACTCTACTGAGGAAGGTACTTCTGAAAGC<br>GCAACCCCGGAGTCGGCCCAGGTACTTCTACCGAACCGTCCGA<br>AGGGCAGCGCACCAGGTACTTCTACCGAACCGTCCGAGGGTAG<br>CGCACCAGGTAGCCCAGCAGGTTCTCCTACCTCCACCGAGGAA<br>GGTACTTCTACCGAACCGTCCGAGGGTAGCGCACCAGGTACCT<br>CTACTGAACCTTCTGAGGGCAGCGCACCAGGTACTTCTGAAAGC<br>GCTACCCCGGAGTCCGGTCCAGGTACTTCTACTGAACCGTCCGA<br>AGGTAGCGCACCAGGTACTTCTGAAAGCGCAACCCCTGAATCC<br>GGTCCAGGTAGCGAACCGGCTACTTCTGGCTCTGAGACTCCAG<br>GTACTTCTACCGAACCGTCCGAAGGTAGCGCACCAGGTACTTCT<br>ACTGAACCGTCCGAAGGTAGCGCACCAGGTACTTCTGAAAGCG | 810 |

TABLE 37-continued

Exemplary GHXTEN comprising growth hormones, XTEN and cleavage sequences

| GHXTEN Name* | Amino Acid Sequence | SEQ ID NO: | DNA Nucleotide Sequence | SEQ ID NO: |
|---|---|---|---|---|
| | PGSPAGSPTSTEEGT | | CAACCCCGGAATCCGGCCCAGGTACCTCTGAAAGCGCAACCCC | |
| | SESATPESGPGSEPA | | GGAGTCCGGCCCAGGTAGCCCTGCTGGCTCTCCAACCTCCACCG | |
| | TSGSETPGTSESATPE | | AAGAAGGTACCTCTGAAAGCGCAACCCTGAATCCGGCCCAGG | |
| | SGPGTSTEPSEGSAP | | TAGCGAACCGGCAACCTCCGGTTCTGAAACCCAGGTACCTCT | |
| | GTSTEPSEGSAPGTS | | GAAAGCGCTACTCCGGAGTCTGGCCCAGGTACCTCTACTGAAC | |
| | TEPSEGSAPGTSTEPS | | CGTCTGAGGGTAGCGCTCCAGGTACTTCTACTGAACCGTCCGAA | |
| | EGSAPGTSTEPSEGS | | GGTAGCGCACCAGGTACTTCTACCGAACCGTCCGAAGGCAGCG | |
| | APGTSTEPSEGSAPG | | CTCCAGGTACCTCTACTGAACCTTCCGAGGGCAGCGCTCCAGGT | |
| | SPAGSPTSTEEGTSTE | | ACCTCTACCGAACCTTCTGAAGGTAGCGCACCAGGTACTTCTAC | |
| | PSEGSAPGTSESATP | | CGAACCGTCCGAGGGTAGCGCACCAGGTAGCCCAGCAGGTTCT | |
| | ESGPGSEPATSGSET | | CCTACCTCCACCGAGGAAGGTACTTCTACCGAACCGTCCGAGG | |
| | PGTSESATPESGPGS | | GTAGCGCACCAGGTACCTCTGAAAGCGCAACTCCTGAGTCTGG | |
| | EPATSGSETPGTSES | | CCCAGGTAGCGAACCTGCTACCTCCGGCTCTGAGACTCCAGGT | |
| | ATPESGPGTSTEPSE | | ACCTCTGAAAGCGCAACCCCGGAATCTGGTCCAGGTAGCGAAC | |
| | GSAPGTSESATPESG | | CTGCAACCTCTGGCTCTGAAACCCCAGGTACCTCTGAAAGCGCT | |
| | PGSPAGSPTSTEEGSP | | ACTCCTGAATCTGGCCCAGGTACTTCTACTGAACCGTCCGAGGG | |
| | AGSPTSTEEGSPAGS | | CAGCGCACCAGGTACTTCTGAAAGCGCTACTCCTGAGTCCGGC | |
| | PTSTEEGTSESATPES | | CCAGGTAGCCCGGCTGGCTCTCCGACTTCCACCGAGGAAGGTA | |
| | GPGTSTEPSEGSAPG | | GCCCGGCTGGCTCTCCAACTTCTACTGAAGAAGGTAGCCCGGC | |
| | TSESATPESGPGSEP | | AGGCTCTCCGACTCCTACTGAGAAGGTACTTCTGAAAGCGCA | |
| | ATSGSETPGTSESAT | | ACCCCGGAGTCCGGCCCAGGTACCTCTACCGAACCGTCTGAGG | |
| | PESGPGSEPATSGSE | | GCAGCGCACCAGGTACCTCTGAAAGCGCAACTCCTGAGTCTGG | |
| | TPGTSESATPESGPG | | CCCAGGTAGCGAACCTGCTACCTCCGGCTCTGAGACTCCAGGT | |
| | TSTEPSEGSAPGSPA | | ACCTCTGAAAGCGCAACCCCGGAATCTGGTCCAGGTAGCGAAC | |
| | GSPTSTEEGTSESATP | | CTGCAACCTCTGGCTCTGAAACCCCAGGTACCTCTGAAAGCGCT | |
| | ESGPGSEPATSGSET | | ACTCCTGAATCTGGCCCAGGTACTTCTACTGAACCGTCCGAGGG | |
| | PGTSESATPESGPSP | | CAGCGCACCAGGTAGCCCTGCTGGCTCTCCAACCTCCACCGAA | |
| | AGSPTSTEEGSPAGS | | GAAGGTACCTCTGAAAGCGCAACCCCTGAATCCGGCCCAGGTA | |
| | PTSTEEGTSTEPSEGS | | GCGAACCGGCAACCTCCGGTTCTGAAACCCAGGTACTTCTGA | |
| | APGTSESATPESGPG | | AAGCGCTACTCCTGAGTCCGGCCCAGGTAGCCCCGGCTGGCTCTC | |
| | TSESATPESGPGTSES | | CGACTTCCACCGAGGAAGGTAGCCCGGCTGGCTCTCCAACTTCT | |
| | ATPESGPGSEPATSG | | ACTGAAGAAGGTACTTCTACCGAACCTTCCGAGGGCAGCGCAC | |
| | SETPGSEPATSGSETP | | CAGGTACTTCTGAAACCCCTGAGTCCGGGCCAGGTACT | |
| | GSPAGSPTSTEEGTS | | TCTGAAAGCGCTACTCCTGAATCCGGTCCAGGTACTTCTGAAAG | |
| | TEPSEGSAPGTSTEPS | | CGCTACCCCGGAATCTGGCCCAGGTAGCGAACCGGCTACTTCT | |
| | EGSAPGSEPATSGSE | | GGTTCTGAAACCCCAGGTAGCGAACCGGCTACTCCGGTTCTG | |
| | TPGTSESATPESGPG | | AAACTCCAGGTAGCCAGCAGGCTCTCCGACTTCCACTGAGGA | |
| | TSTEPSEGSAPGFPTI | | AGGTACTTCTACTGAACCTTCCGAAGGCAGCGCACCAGGTACC | |
| | PLSRLFDNAMLRAH | | TCTACTGAACCTTCTGAGGGCAGCGCTCCAGGTAGCGAACCTG | |
| | RLHQLAFDTYQEFEE | | CAACCTCTGGCTCTGAAACCCCAGGTACCTCTGAAAGCGCTACT | |
| | AYIPKEQKYSFLQNP | | CCTGAATCTGGCCCAGGTACTTCTACTGAACCGTCCGAGGGCA | |
| | QTSLCFSESIPTPSNR | | GCGCACCAGGTTTTCCGACTATTCCGCTGTCTCGTCTGTTTGAT | |
| | EETQQKSNLELLRIS | | AATGCTATGCTGCGTGCGCACCGTCTGCACCAGCTGGCCTTTGA | |
| | LLLIQSWLEPVQFLR | | TACTTACCAGGAATTTGAAGAAGcTACATTCCTAAAGAGCAGA | |
| | SVFANSLVYGASDS | | AGTACTCTTTCTGCAAAACCCACAGACTTCTCTCTGCTTCAGC | |
| | NVYDLLKDLEEGIQT | | GAATCTATTCCGACGCCTTCCAATCGCGAGGAAACTCAGCAAA | |
| | LMGRLEDGSPRTGQI | | AGTCCAATCTGGAACTACTCCGCATTTCTCTGCTTCTGATTCAG | |
| | FKQTYSKFDTNSHN | | AGCTGGCTAGAACCAGTGCAATTTCTGCGTTCCGTCTTCGCCAA | |
| | DDALLKNYGLLYCF | | TAGCCTAGTTTATGGCGCATCCGACAGCAACGTATACGATCTCC | |
| | RKDMDKVETFLRIV | | TGAAAGATCTCGAGGAAGGCATTCAGACCCTGATGGGTCGTCT | |
| | QCRSVEGSCGFGGG | | CGAGGATGGCTCTCCGCGTACTGGTCAGATCTTCAAGCAGACTT | |
| | LGPVSGVPGGTSESA | | ACTCTAAATTTGATACTAACAGCCACAATGACGATGCGCTTCTA | |
| | TPESGPGSEPATSGS | | AAAAACTATGGTCTGCTGTATTGTTTTCGTAAAGATATGGACAA | |
| | ETPGTSESATPESGP | | AGTTGAAACCTTCCTGCGTATTGTTCAGTGTCGTTCCGTTGAGG | |
| | GSEPATSGSETPGTS | | GCAGCTGTGGTTTCTAAGGTggcggcctgggcccggtgagcggcgtgccgGGT | |
| | ESATPESGPGTSTEPS | | GGTACCTCTGAAAGCGCAACTCCTGAGTCTGGCCCAGGTAGCG | |
| | EGSAPGSPAGSPTST | | AACCTGCTACCTCCGGCTCTGAGACTCCAGGTACCTCTGAAAGC | |
| | EEGTSESATPESGPG | | GCAACCCCGGATCTGGTGTAGCGAACCTGCAACCTCTG | |
| | SEPATSGSETPGTSES | | GCTCTGAAACCCCAGGTACCTCTGAAAGCGCTACTCCTGAATCT | |
| | ATPESGPGSPAGSPT | | GGCCCAGGTACTTCTACTGAACCGTCCGAGGGCAGCGCACCAG | |
| | STEEGSPAGSPTSTEE | | GTAGCCCTGCTGGCTCTCCAACCTCCACCGAAGAAGGTACCTC | |
| | GTSTEPSEGSAPGTS | | GAAAGCGCAACCCCTGAATCCGGCCCAGGTAGCGAACCGGCAA | |
| | ESATPESGPGTSESA | | CCTCCGGTTCTGAAACCCAGGTACTTCTGAAAGCGCTACTCCT | |
| | TPESGPGTSESATPES | | GAGTCCGGCCCAGGTAGCCCGGCTGGCTCTCCGACTTCCACCG | |
| | GPGSEPATSGSETPG | | AGGAAGGTAGCCCGGCTGGCTCTCCAACTTCTACTGAAGAAGG | |
| | SEPATSGSETPGSPA | | TACTTCTACCGAACCTTCCGAGGGCAGCGCACCAGGTACTTCTG | |
| | GSPTSTEEGTSTEPSE | | AAAGCGCTACCCCTGAGTCCGGCCCAGGTACTTCTGAAAGCGC | |
| | GSAPGTSTEPSEGSA | | TACTCCTGAATCCGGTCCAGGTACTTCTGAAAGCGCTACCCCGG | |
| | PGSEPATSGSETPGT | | AATCTGGCCCAGGTAGCGAACCGGCTACTTCTGGTTCTGAAACC | |
| | SESATPESGPGTSTEP | | CCAGGTAGCGAACCGGCTACTCCGGTTCTGAAACTCCAGGTA | |
| | SEGSAP | | GCCCAGCAGGCTCTCCGACTTCCACTGAGGAAGGTACTTCTACT | |
| | | | GAACTTCCGAAGGCAGCGCACCAGGTACCTCTACTGAACCTT | |
| | | | CTGAGGGCAGCGCTCCAGGTAGCGAACCTGCAACCTCTGGCTC | |
| | | | TGAAACCCCAGGTACCTCTGAAAGCGCTACTCCTGAATCTGGCC | |
| | | | CAGGTACTTCTACTGAACCGTCCGAGGGCAGCGCACCA | |

TABLE 37-continued

Exemplary GHXTEN comprising growth hormones, XTEN and cleavage sequences

| GHXTEN Name* | Amino Acid Sequence | SEQ ID NO: | DNA Nucleotide Sequence | SEQ ID NO: |
|---|---|---|---|---|
| AE912-hGH-MMP-17-AE288 | MAEPAGSPTSTEEGT PGSGTASSSPGSSTPS GATGSPGASPGTSST GSPGSPAGSPTSTEE GTSESATPESGPGTS TEPSEGSAPGSPAGS PTSTEEGTSTEPSEGS APGTSTEPSEGSAPG TSESATPESGPGSEP ATSGSETPGSEPATS GSETPGSPAGSPTST EEGTSESATPESGPG TSTEPSEGSAPGTSTE PSEGSAPGSPAGSPT STEEGTSTEPSEGSAP GTSTEPSEGSAPGTS ESATPESGPGTSTEPS EGSAPGTSESATPES GPGSEPATSGSETPG TSTEPSEGSAPGTSTE PSEGSAPGTSESATP ESGPGTSESATPESG PGSPAGSPTSTEEGT SESATPESGPGSEPA TSGSETPGTSESATPE SGPGTSTEPSEGSAP GTSTEPSEGSAPGTS TEPSEGSAPGTSTEPS EGSAPGTSTEPSEGS APGTSTEPSEGSAPG SPAGSPTSTEEGTSTE PSEGSAPGTSESATP ESGPGSEPATSGSET PGTSESATPESGPGS EPATSGSETPGTSES ATPEGPGTSTEPSE GSAPGTSESATPESG PGSPAGSPTSTEEGSP AGSPTSTEEGSPAGS PTSTEEGTSESATPES GPGTSTEPSEGSAPG TSESATPESGPGSEP ATSGSETPGTSESAT PESGPGSEPATSGSE TPGTSESATPESGPG TSTEPSEGSAPGSPA GSPTSTEEGTSESATP ESGPGSEPATSGSET PGTSESATPESGPGSP AGSPTSTEEGSPAGS PTSTEEGTSTEPSEGS APGTSESATPESGPG TSESATPESGPGSEPATSG SETPGSEPATSGSETP GSPAGSPTSTEEGTS TEPSEGSAPGTSTEPS EGSAPGSEPATSGSE TPGTSESATPESGPG TSTEPSEGSAPGFPTI PLSRLFDNAMLRAH RLHQLAFDTYQEFEE AYIPKEQKYSFLQNP QTSLCFSESIPTPSNR EETQQKSNLELLRIS LLLIQSWLEPVQFLR SVFANSLVYGASDS NVYDLLKDLEEGIQT LMGRLEDGSPRTGQI FKQTYSKFDTNSHN DDALLKNYGLLYCF RKDMDKVETFLRIV QCRSVEGSCGFAPL GLRLRGGGGTSESA | 811 | ATGGCTGAACCTGCTGGCTCTCCAACCTCCACTGAGGAAGGTA CCCCGGGTAGCGGTACTGCTTCTTCCTCTCCAGGTAGCTCTACC CCTTCTGGTGCAACCGGCTCTCCAGGTGCTTCTCCGGGCACCAG CTCTACCGGTTCTCCAGGTAGCCCGGCTGGCTCTCCTACCTCTA CTGAGGAAGGTACTTCTGAAAGCGCTACTCCTGAGTCTGGTCCA GGTACCTCTACTGAACCGTCCGAAGGTAGCGCTCCAGGTAGCC CAGCAGGCTCTCCGACTTCCACTGAGGAAGGTACTTCTACTGAA CCTTCCGAAGGCAGCGCACCAGGTACCTCTACTGAACCTTCTGA GGGCAGCGCTCCAGGTACTTCTGAAAGCGCTACCCCGGAATCT GGCCCAGGTAGCGAACCGGCTACTTCTGGTTCTGAAACCCCAG GTAGCGAACCGGCTACCTCCGGTTCTGAAACTCCAGGTAGCCC GGCAGGCTCTCCGACCTCTACTGAGGAAGGTACTTCTGAAAGC GCAACCCCGGAGTCCGGCCCAGGTACCTCTACCGAACCGTCTG AGGGCAGCGCACCAGGTACTTCTACCGAACCGTCCGAGGGTAG CGCACCAGGTACTTCTCAGCAGGTTCTCCTACCTCCACCGAGGA GGTACTTCTACCGAACCGTCCGAGGGTAGCGCACCAGGTACCT CTACTGAACCTTCTGAGGGCAGCGCTCCAGGTACTTCTGAAAGC GCTACCCCGGAGTCCGGTCCAGGTACTTCTACTGAACCGTCCGA AGGTAGCGCACCAGGTACTTCTGAAAGCGCAACCCCTGAATCC GGTCCAGGTAGCGAACCGGCTACTTCTGGCTCTGAGACTCCAG GTACTTCTACCGAACCGTCCGAAGGTAGCGCACCAGGTACTTCT ACTGAACCGTCTGAAGGTAGCGCACCAGGTACTTCTGAAAGCG CAACCCCGGAATCCGGCCCAGGTAGCCCTGCTGGCTCTCCAACCTCCACCG AAGAAGGTACTTCTGAAAGCGCAACCCCTGAATCCGGCCCAGG TAGCGAACCGGCAACCTCCGGTTCTGAAACCCCAGGTACCTCT GAAAGCGCTACTCCGGAGTCTGGCCCAGGTACCTCTACTGAAC CGTCTGAGGGTAGCGCTCCAGGTACTTCTACTGAACCGTCCGAA GGTAGCGCACCAGGTACTTCTACCGAACCGTCCGAAGGCAGCG CTCCAGGTACCTCTACTGAACCTTCCGAGGGCAGCGCTCCAGGT ACCTCTACCGAACCTTCTGAAGGTAGCGCACCAGGTACTTCTAC CGAACCGTCCGAGGGTAGCGCACCAGGTACCCAGCAGGTTCT CCTACCTCCACCGAGGAAGGTACTTCTACCGAACCGTCCGAGG GTAGCGCACCAGGTACCTCTGAAAGCGCAACTCCTGAGTCTGG CCCAGGTAGCGAACCTGCTACCTCCGGCTCTGAGACTCCAGGT ACCTCTGAAAGCGCAACCCCGGAATCTGGTCCAGGTAGCGAAC CTGCAACCTCTGGCTCTGAAACCCCAGGTACCTCTGAAAGCGCT ACTCCTGAATCTGGCCCAGGTACTTCTACTGAACCGTCCGAGGG CAGCGCACCAGGTACTTCTGAAAGCGCTACTCCTGAGTCCGGC CCAGGTAGCCCTGCTGGCTCTCCACCGAGGAAGGTA GCCCGGCTGGCTCTCCAACTTCTACTGAAGAAGGTAGCCCGGC AGGCTCTCCGACCTCTACTGAGGAAGGTACTTCTGAAAGCGCA ACCCCGGAGTCCGGCCCAGGTACCTCTACCGAACCGTCTGAGG GCAGCGCACCAGGTACCTCTGAAAGCGCAACTCCTGAGTCTGG CCCAGGTAGCGAACCTGCTACCTCCGGCTCTGAGACTCCAGGT ACCTCTGAAAGCGCAACCCCGGAATCTGGTCCAGGTAGCGAAC CTGCAACCTCTGGCTCTGAAACCCCAGGTACCTCTGAAAGCGCT ACTCCTGAATCTGGCCCAGGTACTTCTACTGAACCGTCCGAGGG CAGCGCACCAGGTAGCCCTGCTGGCTCTCCAACCTCCACCGAA GAAGGTACTTCTGAAAGCGCAACCCCTGAATCCGGCCCAGGTA GCGAACCGGCAACCTCCGGTTCTGAAACCCCAGGTACTTCTGA AAGCGCTACTCCTGAGTCCGGCCCAGGTAGCCCGGCTGGCTCTC CGACTTCCACCGAGGAAGGTAGCCCCGGCTGGCTCTCCAACTTCT ACTGAAGAAGGTACTTCTACCGAACCTTCCGAGGGCAGCGCAC CAGGTACTTCTGAAAGCGCTACCCCTGAGTCCGCCCAGGTACT TCTGAAAGCGCTACTCCTGAATCCGGTCCAGGTACTTCTGAAAG CGCTACCCCGGAATCCGGTAGCGAACCGGCTACTTCT GGTTCTGAAACCCCAGGTAGCGAACCGGCTACCTCCGGTTCTG AAACTCCAGGTAGCCCAGCAGGCTCTCCGACTTCCACTGAGGA AGGTACTTCTACTGAACCTTCCGAAGGCAGCGCACCAGGTACC TCTACTGAACCTTCTGAGGGCAGCGCTCCAGGTAGCGAACCTG CAACCTCTGGCTCTGAAACCCCAGGTACCTCTGAAAGCGCTACT CCTGAATCTGGCCCAGGTACTTCTACTGAACCGTCCGAGGGCA GCGCACCAGGTTTTCCGACTATTCCGCTGTCTCGTCTGTTTGAT AATGCTATGCTGCGTGCACCGTCTGCACCAGCTGGCCTTTGA TACTTACCAGGAATTTGAAGAAGCcTACATTCCTAAAGAGCAGA AGTACTCTTTCCTGCAAAACCCACAGACTTCTCTCTGCTTCAGC GAATCTATTCCGACGCCTTCCAATCGCGAGGAAACTCAGCAAA AGTCCAATCTGGAACTACTCCGCATTTGTCTGCTTCTGATTCAG CTGCTGCTGATTCAGTCCTGGCTAGAACCAGTGCAATTTCTGCGTTCCGTCTTCGCCAA TAGCCTAGTTTATGGCGCATCCGACAGCAACGTATACGATCTCC TGAAAGATCTCGAGGAAGGCATTCAGACCCTGATGGGTCGTCT CGAGGATGGCTCTCCGCGTACTGGTCAGATCTTCAAGCAGACTT ACTCTAAATTTGATACTAACAGCCACAATGACGATGCGCTTCTA | 812 |

TABLE 37-continued

Exemplary GHXTEN comprising growth hormones, XTEN and cleavage sequences

| GHXTEN Name* | Amino Acid Sequence | SEQ ID NO: | DNA Nucleotide Sequence | SEQ ID NO: |
|---|---|---|---|---|
| | TPESGPGSEPATSGS ETPGTSESATPESGP GSEPATSGSETPGTS ESATPESGPGTSTEPS EGSAPGSPAGSPTST EEGTSESATPESGPG SEPATSGSETPGTSES ATPESGPGSPAGSPT STEEGSPAGSPTSTEE GTSTEPSEGSAPGTS ESATPESGPGTSESA TPESGPGTSESATPES GPGSEPATSGSETPG SEPATSGSETPGSPA GSPTSTEEGTSTEPSE GSAPGTSTEPSEGSA PGSEPATSGSETPGT SESATPESGPGTSTEP SEGSAP | | AAAAACTATGGTCTGCTGTATTGTTTTCGTAAAGATATGGACAA AGTTGAAACCTTCCTGCGTATTGTTCAGTGTCGTTCCGTTGAGG GCAGCTGTGGTTTCTAAGGTgcgccgctgggcctgcgcctgcgcggcggcGGTG GTACCTCTGAAAGCGCAACTCCTGAGTCTGGCCCAGGTAGCGA ACCTGCTACCTCCGGCTCTGAGACTCCAGGTACCTCTGAAAGCG CAACCCCGGAATCTGGTCCAGGTAGCGAACCTGCAACCTCTGG CTCTGAAACCCCAGGTACCTCTGAAAGCGCTACTCCTGAATCTG GCCCAGGTACTTCTACTGAACCGTCCGAGGGCAGCGCACCAGG TAGCCCTGCTGGCTCTCCAACCTCCACCGAAGAAGGTACCTCTG AAAGCGCAACCCCTGAATCCGGCCCAGGTAGCGAACCGGCAAC CTCCGGTTCTGAAACCCCAGGTACTTCTGAAAGCGCTACTCCTG AGTCCGGCCCAGGTAGCCCGGCTGGCTCTCCGACTTCCACCGA GGAAGGTAGCCCGGCTGGCTCTCCAACTTCTACTGAAGAAGGT ACTTCTACCGAACCTTCCGAGGGCAGCGCACCAGGTACTTCTGA AAGCGCTACCCCTGAGTCCGGCCCAGGTACTTCTGAAAGCGCT ACTCCTGAATCCGGTCCAGGTACTTCTGAAAGCGCTACCCCTGA ATCTGGCCCAGGTAGCGAACCGGCTACTTCTGGTTCTGAAACCC CAGGTAGCGAACCGGCTACCTCCGGTTCTGAAACTCCAGGTAG CCCAGCAGGCTCTCCGACTTCCACTGAGGAAGGTACTTCTACTG AACCTTCCGAAGGCAGCGCACCAGGTACCTCTACTGAACCTTCT GAGGGCAGCGCTCCAGGTAGCGAACCTGCAACCTCTGGCTCTG AAACCCCAGGTACCTCTGAAAGCGCTACTCCTGAATCTGGCCC AGGTACTTCTACTGAACCGTCCGAGGGCAGCGCACCA | |
| AM923-hGH-Thrombin-AE144 | MAEPAGSPTSTEEGA SPGTSSTGSPGSSTPS GATGSPGSSTPSGAT GSPGTSTEPSEGSAP GSEPATSGSETPGSP AGSPTSTEEGSTSST AESPGPGTSTPESGS ASPGTSESPSGTAP GSTSESPSGTAPGTS TPESGSASPGTSTPES GSASPGSEPATSGSE TPGTSESATPESGPG SPAGSPTSTEEGTSTE PSEGSAPGTSESATP ESGPGTSTEPSEGSA PGTSTEPSEGSAPGSP AGSPTSTEEGTSTEPS EGSAPGTSTEPSEGS APGTSESATPESGPG TSESATPESGPGTSTE PSEGSAPGTSTEPSE GSAPGTSESATPESG PGTSTEPSEGSAPGS EPATSGSETPGSPAG SPTSTEEGSSTPSGAT GSPGTPGSGTASSSP GSSTPSGATGSPGTS TEPSEGSAPGTSTEPS EGSAPGSEPATSGSE TPGSPAGSPTSTEEG SPAGSPTSTEEGTSTE PSEGSAPGASASGAP STGGTSESATPESGP GSPAGSPTSTEEGSP AGSPTSTEEGSTSST AESPGPGSTSESPSGT APGTSPSGESSTAPG TPGSGTASSSPGSSTP SGATGSPGSSPSAST GTGPGSEPATSGSET PGTSESATPESGPGS EPATSGSETPGSTSST AESPGPGSTSSTAESP GPGTSPSGESSTAPG SEPATSGSETPGSEP ATSGSETPGTSTEPSE GSAPGSTSSTAESPG PGTSTPESGSASPGST SESPSGTAPGTSTEPS EGSAPGTSTEPSEGS APGTSTEPSEGSAPG | 813 | ATGGCTGAACCTGCTGGCTCTCCAACCTCCACTGAGGAAGGTG CATCCCCGGGCACCAGCTCTACCGGTTCTCCAGGTAGCTCTACC CCGTCTGGTGCTACCGGCTCTCCAGGTAGCTCTACCCCGTCTGG TGCTACTGGCTCTCCAGGTACTTCTACTGAACCGTCTGAAGGCA GCGCACCAGGTAGCGAACCGGCTACTTCCGGTTCTGAAACCCC AGGTAGCCCAGCAGGTTCTCCAACTTCTACTGAAGAAGGTTCTA CCAGCTCTACCGCAGAATCTCCTGGTCCAGGTACCTCTACTCCG GAAAGCGGCTCTGCATCTCCAGGTTCTACTAGCGAATCTCCTTC TGGCACTGCACCAGGTTCTACTAGCGAATCCCCGTCTGGTACTG CTCCAGGTACTTCTACTCCTGAAAGCGGTTCCGCTTCTCCAGGT ACCTCTACTCCGGAAAGCGGTTCTGCATCTCCAGGTAGCGAACC GCAACCTCCGGCTCTGAAACCCCAGGTACCTCTGAAAGCGCT ACTCCTGAATCCGGCCCAGGTAGCCCAGGTTCTCCGACCTCCACC GAGGAAGGTACCTCTACTGAACCTTCTGAGGGCAGCGCT CCAGGTACTTCTGAAAGCGCTACCCCGGAGTCCGGTCCAGGTA CTTCTACTGAACCGTCCGAAGGTAGCGCACCAGGTACTTCTACC GAACGTCCGAGGGTAGCGCACCAGGTACCTCTACCGAACCTTCC GAGGGCAGCGCTCCACCTCCACCGAGGAAGGTACTTCTACCGAACCGTCCGAGGG TAGCGCACCAGGTACTTCTACCGAACCTTCCGAGGGCAGCGCA CCAGGTACTTCTGAAAGCGCTACCCCTGAGTCCGGCCCAGGTA CTTCTGAAAGCGCTACTCCTGAATCCGGTCCAGGTACCTCTACT GAACCTTCCGAAGGCAGCGCTCCAGGTACCTCTACCGAACCGT CCGAGGGCAGCGCACCAGGTACTTCTGAAAGCGCAACCCCTGA ATCCGGTCCAGGTACTTCTACTGAACCTTCCGAAGGTAGCGCTC CAGGTAGCGAACCTGCTACTTCTGGTTCTGAAACCCCAGGTAG CCCGGCTGGCTCTCCGACCTCCACCGAGGAAGGTAGCTCTACCCC GTCTGGTGCTACTGGTTCTCCAGGTACTCCGGGCAGCGGTACTG CTTCTTCCTCTCCAGGTAGCTCTACCCCTTCTGGTGCTACTGGCT CTCCAGGTACCTCTACCGAACCGTCTGAGGGTAGCGCTCCAGGTAGCGAA CCGGCAACCTCCGGTTCTGAAACTCCAGGTAGCCCTGCTGGCTC TCCGACTTCTACTGAGGAAGGTAGCCCGGCTGGTTCTCCGACTT CTACTGAGGAAGGTACTTCTACCGAACCTTCCGAAGGTAGCGC TCCAGGTGCAAGCGCAAGCGGCGCGCCAAGCACGGGAGGTACT CTGAAAGCGCTACTCCTGAGTCCGGCCCAGGTAGCCCCGGCTG GCTCTCCGACTTCCACCGAGGAAGGTAGCCCGGCTGGCTCTCCA ACTTCTACTGAAGAAGGTTCTACCAGCTCTACCGCTGAATCTCC TGGCCCAGGTTCTACTAGCGAATCTCCTTCTGGCACCGCACCAG GTACTTCCCCTAGCGGTGAATCTTCTACTGCACCAGGTACCCCT GGCAGCGGTACCGCTTCTTCCTCTCCAGGTAGCTCTACCCCGTC TGGTGCTACTGGCTCTCCAGGTTCTAGCCCGTCTGCATCTACCG GTACCGGCCCAGGTAGCGAACCGGCAACCTCCGGCTCTGAAAC TCCAGGTACTTCTGAAAGCGCTACTCCGGAATCCGGCCCAGGT AGCGAACCGGCTACTTCCGGCTCTGAAACCCAGGTTCACCA GCTCTACTGCAGAATCTCCGGGCCCAGGTTCTACTAGCTCTACT GCAGAATCTCCGGGCCCAGGCACTTCCCCTAGCGGTGAATCTTC TACCGCTCCAGGTAGCGAACCGGCAACCTCTGGCTCTGAAACT CCAGGTAGCGAACCTGCAACCTCCGGCTCTGAAACCCCAGGTA CTTCTACTGAACCTTCTGAGGGCAGCGCACCAGGTTCTACCAGC TCTACCGCAGAATCTCCTGGTCCAGGTACCTCTACTCCGGAAAG CGGCTCTGCATCTCCAGGTTCTACTAGCGAATCTCCTTCTGGCA | 814 |

TABLE 37-continued

Exemplary GHXTEN comprising growth hormones, XTEN and cleavage sequences

| GHXTEN Name* | Amino Acid Sequence | SEQ ID NO: | DNA Nucleotide Sequence | SEQ ID NO: |
|---|---|---|---|---|
| | SSTPSGATGSPGSSPS ASTGTGPGASPGTSS TGSPGSEPATSGSET PGTSESATPESGPGSP AGSPTSTEEGSSTPS GATGSPGSSPSASTG TGPGASPGTSSTGSP GTSESATPESGPGTS TEPSEGSAPGTSTEPS EGSAPGFPTIPLSRLF DNAMLRAHRLHQL AFDTYQEFEEAYIPK EQKYSFLQNPQTSLC FSESIPTPSNREETQQ KSNLELLRISLLLIQS WLEPVQFLRSVFAN SLVYGASDSNVYDL LKDLEEGIQTLMGRL EDGSPRTGQIFKQTY SKFDTNSHNDDALL KNYGLLYCFRKDMD KVETFLRIVQCRSVE GSCGFGLTPRSLLVG GGGSEPATSGSETPG TSESATPESGPGSEP ATSGSETPGSPAGSP TSTEEGTSTEPSEGS APGSEPATSGSETPG SEPATSGSETPGSEP ATSGSETPGTSTEPSE GSAPGTSESATPESG PGSEPATSGSETPGT STEPSEGSAP | | CTGCACCAGGTACTTCTACCGAACCGTCCGAAGGCAGCGCTCC AGGTACCTCTACTGAACCTTCCGAGGGCAGCGCTCCAGGTACCT CTACCGAACCTTCTGAAGGTAGCGCACCAGGTAGCTCTACTCCG TCTGGTGCAACCGGCTCCCCAGGTTCTAGCCCGTCTGCTTCCAC TGGTACTGGCCCAGGTGCTTCCCCGGGCACCAGCTCTACTGGTT CTCCAGGTAGCGAACCTGCTACCTCCGGTTCTGAAACCCCAGGT ACCTCTGAAAGCGCAACTCCGGAGTCTGGTCCAGGTAGCCCTG CAGGTTCTCCTACCTCCACTGAGGAAGGTAGCTCTACTCCGTCT GGTGCAACCGGCTCCCCAGGTTCTAGCCCGTCTGCTTCCACTGG TACTGGCCCAGGTGCTTCCCCGGGCACCAGCTCTACTGGTTCTC CAGGTACCTCTGAAAGCGCTACTCCGGAGTCTGGCCCAGGTAC CTCTACTGAACCGTCTGAGGGTAGCGCTCCAGGTACTTCTACTG AACCGTCCGAAGGTAGCGCACCAGGTTTTCCGACTATTCCGCTG TCTCGTCTGTTTGATAATGCTATGCTGCGTGCGCACCGTCTGCA CCAGCTGGCCTTTGATACTTACCAGGAATTTGAAGAAGCCTACA TTCCTAAAGAGCAGAAGTACTCTTTCCTGCAAAACCCACAGACT TCTCTGCTTCAGCGAATCTATTCCGACGCCTTCCAATCGCGA GGAAACTCAGCAAAGTCAATCTGGAACTACTCCGCATTTCTC TGCTTCTGATTCAGAGCTGGCTAGAACCAGTGCAATTTCTGCGT TCCGTCTTCGCCAATAGCCTAGTTTATGGCGCATCCGACAGCAA CGTATACGATCTCCTGAAAGATCTCGAGGAAGGCATTCAGACC CTGATGGGTCGTCTCGAGGATGGCTCTCCGCGTACTGGTCAGAT CTTCAAGCAGACTTACTCTAAATTTGATACTAACAGCCACAATG ACGATGCGCTTCTAAAAAACTATGGTCTGCTGTATTGTTTTCGT AAAGATATGGACAAAGTTGAAACCTTCCTGCGTATTGTTCAGTG TCGTTCCGTTGAGGGCAGCTGTGGTTTCTAAGGTctgacccgcgcagc ctgctggtgggcggcGGTGGTAGCGAACCGGCAACTTCCGGCTCTGAA ACCCCAGGTTCTGAAAGCGCTACTCCTGAGTCTGGCCCAGG TAGCGAACCTGCTACCTCTGGCTCTGAAACCCCAGGTAGCCCG GCAGGCTCTCCGACTTCCACCGAGGAAGGTACCTCTACTGAAC CTTCTGAGGGTAGCGCTCCAGGTAGCGAACCGGCAACCTCTGG CTCTGAAACCCCAGGTAGCGAACCTGCTACCTCCGGCTCTGAA ACTCCAGGTAGCGAACCTGCTACTTCCGGTTCTGAAACTCCAG GTACCTCTACCGAACCTTCCGAAGGCAGCGCACCAGGTACTTCT GAAAGCGCAACCCCTGAATCCGGTCCAGGTAGCGAACCGGCTA CTTCTGGCTCTGAGACTCCAGGTACTTCTACCGAACCGTCCGAA GGTAGCGCACCA | |
| AM923-hGH-FXIa-AE144 | MAEPAGSPTSTEEGA SPGTSSTGSPGSSTPS GATGSPGSSTPSGAT GSPGTSTEPSEGSAP GSEPATSGSETPGSP AGSPTSTEEGSTSST AESPGPGTSTPESGS ASPGSTSESPSGTAP GSTSESPSGTAPGTS TPESGSASPGTSTPES GSASPGSEPATSGSE TPGTSESATPESGPG SPAGSPTSEEGTSTE PSEGSAPGTSESATP ESGPGTSTEPSEGSA PGTSTEPSEGSAPGSP AGSPTSTEEGTSTEPS EGSAPGTSTEPSEGS APGTSESATPESGPG TSESATPESGPGTSTE PSEGSAPGTSTEPSE GSAPGTSESATPESG PGTSTEPSEGSAPGS EPATSGSETPGSPAG SPTSTEEGSSTPSGAT GSPGTPGSGTASSSP GSSTPSGATGSPGTS TEPSEGSAPGTSTEPS EGSAPGEPATSGSE TPGSPAGSPTSTEEG SPAGSPTSTEEGTSTE PSEGSAPGASASGAP STGGTSESATPESGP GSPAGSPTSTEEGSP AGSPTSTEEGSTSST AESPGPGSTSESPSGT APGTSPSGESSTAPG | 815 | ATGGCTGAACCTGCTGGCTCTCCAACCTCCACTGAGGAAGGTG CATCCCCGGGCACCAGCTCTACCGGTTCTCCAGGTAGCTCTACC CCGTCTGGTGCTACCGGCTCTCCAGGTACCTCTACCCCGTCTGG TGCTACTGGCTCTCCAGGTACTTCTACTGAACCCTCTGAAGGCA GCGCACCAGGTAGCGAACCGGCTACTTCCGGTTCTGAAACCCC AGGTAGCCCAGCAGGTTCTCCAACTTCTACTGAAGAAGGTTCTA CCAGCTCTACCGCAGAATCTCCTGGTCCAGGTACCTCTACTCCG GAAAGCGGCTCTGCATCTCCAGGTTCTACTAGCGAATCTCCTTC TGGCACTGCACCAGGTTCTACTAGCGAATCCCCGTCTGGTACTG CTCCAGGTACTTCTACTCCTGAAAGCGGTTCCGCTTCTCCAGGT ACCTCTACTCCGGAAAGCGGTTCTGCATCTCCAGGTAGCGAACC TGGCAACCTCCGGCTCTGAAACCCCAGGTACCTCTGAAAGCGCT ACTCCTGAATCCGGCCCAGGTAGCCCGGCAGGTTCTCCGACTTC CACTGAGGAAGGTACCTCTACTGAACCTTCTGAGGGCAGCGCT CCAGGTACTTCTGAAAGCGCTACCCCGGAGTCCGGTCCAGGTA CTTCTACTGAACCGTCCGAAGGTAGCGCACCAGGTAGCCAGCAGGTTCTC CTACCTCCACCGAGGAAGGTACTTCTACCGAACCGTCCGAGGG TAGCGCACCAGGTACTTCTACCGAACCGTCCGAGGGCAGCGCA CCAGGTACTTCTGAAAGCGCTACCCCGGAGTCCGGTCCAGGTA CTTCTGAAAGCGCTACTCCTGAATCCGGTCCAGGTACCTCTACT GAACCTTCCGAAGGCAGCGCTCCAGGTACCTCTACCGAACCGT CCGAGGGCAGCGCACCAGGTACTTCTGAAAGCGCAACCCCTGA ATCCGGTCCAGGTAGCGAACCTTCTACTGAATCCGGTAGCCCTG CAGGTAGCGAACCTGCTACTTCTGGTTCTGAAACCCCAGGTAGC CCGGCTGGCTCTCCGACCTCCACCGAGGAAGGTAGCTCTACCCC GTCTGGTGCTACTGGTTCTCCAGGTACTCCGGGCAGCGGTACTG CTTCTTCCTCTCCAGGTAGCTCTACCCCTTCTGGTGCTACTGGCT CTCCAGGTACCTCTACCGAACCGTCCGAGGGTAGCGCACCAGG TACCTCTACTGAACCGTCTGAGGGTAGCGCTCCAGGTAGCGAA CCGGCAACCTCCGGTTCTGAAACTCCAGGTAGCCCTGCTGGCTC TCCGACTTCTACTGAAGAAGGTTCCCCGGCTGGTTCTCCGACTT CTACTGAGGAAGGTACTTCTACCGAACCTTCCGAAGGTAGCGC TCCAGGTGCAAGCGCAAGCGGCGCGCCAAGCACGGGAGGTACT TCTGAAAGCGCTACTCCTGAGTCCGGCCCAGGTAGCCCGGCTG GCTCTCCGACTTCCACCGAGGAAGGTAGCCCGGCTGGCTCTCCA ACTTCTACTGAAGAAGGTTCTACCAGCTCTACCGCTGAATCTCC | 816 |

TABLE 37-continued

Exemplary GHXTEN comprising growth hormones, XTEN and cleavage sequences

| GHXTEN Name* | Amino Acid Sequence | SEQ ID NO: | DNA Nucleotide Sequence | SEQ ID NO: |
|---|---|---|---|---|
| | TPGSGTASSSPGSSTP SGATGSPGSSPSAST GTGPGSEPATSGSET PGTSESATPESGPGS EPATSGSETPGSTSST AESPGPGSTSSTAESP GPGTSPSGESSTAPG SEPATSGSETPGSEP ATSGSETPGTSTEPSE GSAPGSTSSTAESPG PGTSTPESGSASPGST SESPSGTAPGTSTEPS EGSAPGTSTEPSEGS APGTSTEPSEGSAPG SSTPSGATGSPGSSPS ASTGTGPGASPGTSS TGSPGSEPATSGSET PGTSESATPESGPGSP AGSPTSEEGSSTPS GATGSPGSSPSASTG TGPGASPGTSSTGSP GTSESATPESGPGTS TEPSEGSAPGTSTEPS EGSAPGFPTTPLSRLF DNAMLRAHRLHQL APDTYQEFEEAYIPK EQKYSFLQNPQTSLC FSESIPTPSNREETQQ KSNLELLRISLLLIQS WLEPVQFLRSVFAN SLVYGASDSNVYDL LKDLEEGIQTLMGRL EDGSPRTGQIFKQTY SKFDTNSHNDDALL KNYGLLYCFRKDMD KVETFLRIVQCRSVE GSCGFGGGKLTRVV GGGGSEPATSGSETP GTSESATPESGPGSE PATSGSETPGSPAGS PTSTEEGTSTEPSEGS APGSEPATSGSETPG SEPATSGSETPGSEP ATSGSETPGTSTEPSE GSAPGTSESATPESG PGSEPATSGSETPGT STEPSEGSAP | | TGGCCCAGGTTCTACTAGCGAATCTCCGTCTGGCACCGCACCAG GTACTTCCCCTAGCGGTGAATCTTCTACTGCACCAGGTACCCCT GGCAGCGGTACCGCTTCTTCCTCTCCAGGTAGCTCTACCCCGTC TGGTGCTACTGGCTCTCCAGGTTCTAGCCCGTCTGCATCTACCG GTACCGGCCCAGGTAGCGAACCGGCAACCTCCGGCTCTGAAAC TCCAGGTACTTCTGAAAGCGCTACTCCGGAATCCGGCCCAGGT AGCGAACCGGCTACTTCCGGCTCTGAAACCCCAGGTTCCACCA GCTCTACTGCAGAATCTCCGGGCCCAGGTTCTACTAGCTCTACT GCAGAATCTCCGGGTCCAGGTACTTCTCCTAGCGGCGAATCTTC TACCGCTCCAGGTAGCGAACCGGCAACCTCTGGCTCTGAAACT CCAGGTAGCGAACCTGCAACCTCCGGCTCTGAAACCCCAGGTA CTTCTACTGAACCTTCTGAGGGCGAGCGCACCAGGTTCTACCAGC TCTACCGCAGAATCTCCTGGTCCAGGTACCTCTACTCCGGAAAG CGGCTCTGCATCTCCAGGTTCTACTAGCGAATCTCCTTCTGGCA CTGCACCAGGTACTTCTACCGAACCGTCCGAAGGCAGCGCTCC AGGTACCTCTACTGAACCTTCCGAGGGCAGCGCTCCAGGTACCT CTACCGAACCTTCTGAAGGTAGCGCACCAGGTAGCTCTACTCCG TCTGGTGCAACCGGCTCCCCAGGTTCTAGCCCGTCTGCTTCCAC TGGTACTGGCCCAGGTGCTTCCCCGGGCACCAGCTCTACTGGTT CTCCAGGTAGCGAACCTGCTACCTCCGGTTCTGAAACCCCAGGT ACCTCTGAAAGCGCAACTCCGGAGTCTGGTCCAGGTAGCCCTG CAGGTTCTCCTACCTCCACTGAGGAAGGTAGCTCTACTCCGTCT GGTGCAACCGGCTCCCAGGTTCTAGCCCGTCTGCTTCCACTGG TACTGGCCAGGTGCTTCCCCGGGCACCAGCTCTACTGGTTCTC CAGGTACCTCTGAAAGCGCTACTCCGGAGTCTGGCCCAGGTAC TAGCGCACCAGGTACTTCTACCGAACCTTCCGAGGGCAGCGCT CCAGCTGGCCTTTGATACTTACCAGGAATTTGAAGAAGCCTACA TTCCTAAAGAGCAGAAGTACTCTTTCCTGCAAAACCCACAGACT TCTCTCTGCTTCAGCGAATCTATTCCGACGCCTTCCAATCGCGA GGAAACTCAGCAAAAGTCCAATCTGGAACTACTCCGCATTTCTC TGCTTCTGATTCAGAGCTGGCTAGAACCAGTGCAATTTCTGCGT TCCGTCTTCGCCAATAGCACTAGTTTATGGCGCATCCGACAGCAA CGTATACGATCTCCTGAAAGATCTCGAGGAAGGCATTCAGACC CTGATGGGTCGTCTCGAGGATGGCTCTCCGCGTACTGGTCAGAT CTTCAAGCAGACTTACTCTAAATTTGATACTAACAGCCACAATG ACGATGCGCTTCTAAAAAACTATGGTCTGCTGTATTGTTTTCGT AAAGATATGGACAAAGTTGAAACCTTCCTGCGTATTGTTCAGTG TCGTTCCGTTGAGGGCAGCTGTGGTTTCTAAGGTggcggcaaactgacc cgcgtggtgggcggccgGTGGTAGCGAACCGGCAACTTCCGGCTCTGAA ACCCCAGGTACTTCTGAAAGCGCTACTCCTGAGTCTGGCCCAGG TAGCGAACCTGCTACCTCTGGCTCTGAAACCCCAGGTAGCCCG GCAGGCTCTCCGACTTCCACCGAGGAAGGTACCTCTACTGAAC CTTCTGAGGGTAGCGCTCCAGGTAGCGAACCGGCAACCTCTGG CTCTGAAACCCCAGGTAGCGAACCTGCTACCTCCGGCTCTGAA ACTCCAGGTAGCGAACCGGCTACTTCCGGTTCTGAAACTCCAG GTACCTCTACCGAACCTTCCGAAGGCAGCGCACCAGGTACTTCT GAAAGCGCAACCCCTGAATCCGGTCCAGGTAGCGAACCGGCTA CTTCTGGCTCTGAGACTCCAGGTACTTCTACCGAACCGTCCGAA GGTAGCGCACCA | |
| AM923- hGH- Elastase- AE144 | MAEPAGSPTSEEGA SPGTSSTGSPGSSTPS GATGSPGSSTPSGAT GSPGTSTEPSEGSAP GSEPATSGSETPGSP AGSPTSEEGSTSST AESPGPGTSTPESGS ASPGSTSESPSGTAP GSTSESPSGTAPGTS TPESGSASPGTSTPES GSASPGSEPATSGSE TPGTSESATPESGPG SPAGSPTSEEGTSTE PSEGSAPGTSESATP ESGPGTSTEPSEGSA PGTSTEPSEGSAPGSP AGSPTSEEGTSTEPS EGSAPGTSTEPSEGS APGTSESATPESGPG TSESATPESGPGTSTE PSEGSAPGTSTEPSE GSAPGTSESATPESG PGTSTEPSEGSAPGS | 817 | ATGGCTGAACCTGCTGGCTCTCCAACCTCCACTGAGGAAGGTG CATCCCCGGGCACCAGCTCTACCGGTTCTCCAGGTAGCTCTACC CCGTCTGGTGCTACCGGCTCTCCAGGTAGCTCTACCCCGTCTGG TGCTACTGGCTCTCCAGGTACTTCTACTGAACCGTCTGAAGGCA GCGCACCAGGTAGCGAACCGGCTACTTCCGGTTCTGAAACCCC AGGTAGCCCAGCAGGTTCTCCAACCTCTACTGAAGAAGGTTCA CCAGCTCTACCGCAGAATCTCCTGGTCCAGGTACCTCTACTCCG GAAAGCGGCTCTGCATCTCCAGGTTCTACTAGCGAATCTCCTTC TGGCACTGCACCAGGTTCTACTAGCGAATCCCCGTCTGGTACTG CTCCAGGTACTTCTACTCCTGAAAGCGGTTCCGTTCCCAGGT ACCTCTACTCCGGAAAGCGGTTCTGCATCTCCAGGTAGCGAACC GGCAACCTCCGGCTCTGAAACCCCAGGTACCTCTGAAAGCGCT ACTCCTGAATCCGGCCCAGGTAGCCCGGCAGGTTCTCCGACTTC CACTGAGGAAGGTACCTCTACTGAGGGCAGCGCT CCAGGTACTTCTGAAAGCGCTACCCCGGAGTCCGGTCCAGGTA CTTCTACTGAACCGTCCGAAGGTAGCGCACCAGGTACTTCTACC GAACCGTCCGAGGGTAGCGCACCAGGTAGCCCAGCAGGTTCT CCTACTCCACCGAGGAAGGTACCTCTACCGAACCGTCCGAGG CTACCTCCACCGAGGAAGGTACCTCTACCGAACCGTCCGAAGG TAGCGCACCAGGTACTTCTACCGAACCTTCCGAGGGCAGCGCA CCAGGTACTTCTGAAAGCGCTACCCCTGAGTCCGGCCCAGGTA CTTCTACTGAACCGTCCGAGGTAGCCCAGCAGGTACCTCTACT GAACCTTCCGAAGGCAGCGCTCCAGGTACCTCTACCGAACCGT CCGAGGGCAGCGCACCAGGTACTTCTGAAAGCGCAACCCCTGA | 818 |

TABLE 37-continued

Exemplary GHXTEN comprising growth hormones, XTEN and cleavage sequences

| GHXTEN Name* | Amino Acid Sequence | SEQ ID NO: | DNA Nucleotide Sequence | SEQ ID NO: |
|---|---|---|---|---|
| | EPATSGSETPGSPAG SPTSTEEGSSTPSGAT GSPGTPGSGTASSSP GSSTPSGATGSPGTS TEPSEGSAPGTSTEPS EGSAPGSEPATSGSE TPGSPAGSPTSTEEG SPAGSPTSTEEGTSTE PSEGSAPGASASGAP STGGTSESATPESGP GSPAGSPTSTEEGSP AGSPTSTEEGSTSST AESPGPGSTSESPSGT APGTSPSGESSTAPG TPGSGTASSSPGSSTP SGATGSPGSSPSAST GTGPGSEPATSGSET PGTSESATPESGPGS EPATSGSETPGSTSST AESPGPGSTSSTAESP GPGTSPSGESSTAPG SEPATSGSETPGSEP ATSGSETPGTSTEPSE GSAPGSTSSTAESPG PGTSTPESGSASPGST SESPSGTAPGTSTEPS EGSAPGTSTEPSEGS APGTSTEPSEGSAPG SSTPSGATGSPGSSPS ASTGTGPGASPGTSS TGSPGSEPATSGSET PGTSESATPESGPGSP AGSPTSTEEGSSTPS GATGSPGSSPSASTG TGPGASPGTSSTGSP GTSESATPESGPGTS TEPSEGSAPGTSTEPS EGSAPGFPTIPLSRLF DNAMLRAHRLHQL AFDTYQEFEEAYIPK EQKYSFLQNPQTSLC FSESIPTPSNREETQQ KSNLELLRISLLLIQS WLEPVQFLRSVFAN SLVYGASDSNVYDL LKDLEEGIQTLMGRL EDGSPRTGQIFKQTY SKFDTNSHNDDALL KNYGLLYCFRKDMD KVETFLRIVQCRSVE GSCGFGGGLGPVSG VPGGSEPATSGSETP GTSESATPESGPGSE PATSGSETPGSPAGS PTSTEEGTSTEPSEGS APGSEPATSGSETPG SEPATSGSETPGSEP ATSGSETPGTSTEPSE GSAPGTSESATPESG PGSEPATSGSETPGT STEPSEGSAP | | ATCCGGTCCAGGTACTTCTACTGAACCTTCCGAAGGTAGCGCTC CAGGTAGCGAACCTGCTACTTCTGGTTCTGAAACCCCAGGTAGC CCGGCTGGCTCTCCGACCTCCACCGAGGAAGGTAGCTCTACCCC GTCTGGTGCTACTGGTTCTCCAGGTACTCCGGGCAGCGGTACTG CTTCTTCCTCTCCAGGTAGCTCTACCCCTTCTGGTGCTACTGGCT CTCCAGGTACCTCTACCGAACCGTCCGAGGGTAGCGCACCAGG TACCTCTACTGAACCGTCTGAGGGTAGCGCTCCAGGTAGCGAA CCGGCAACCTCCGGTTCTGAAACTCCAGGTAGCCCTGCTGGCTC TCCGACTTCTACTGAGGAAGGTAGCCCGGCTGGTTCTCCGACTT CTACTGAGGAAGGTACTTCTACCGAACCTTCCGAAGGTAGCGC TCCAGGTGCAAGCGCAAGCGGCGCGCAAGCACGGGAGGTACT TCTGAAAGCGCTACTCCTGAATCCGGCCCAGGTAGCCCGGCTG GCTCTCCGACTTCCACCGAGGAAGGTAGCCCGGCTGGCTCTCCA ACTTCTACTGAAGAAGGTTCTACCAGCTCTACCGCTGAATCTCC TGGCCCAGGTTCTACTAGCGAATCTCCGTCTGGCACCGCACCAG GTACTTCCCCTAGCGGTGAATCTTCTACTGCACCAGGTACCCGT GGCAGCGGTACCGCTTCTTCCTCTCCAGGTAGCTCTACCCCGTC TGGTGCTACTGGCTCTCCAGGTTCTAGCCCGTCTGCATCTACCG GTACCGGCCCAGGTAGCGAACCGGCAACCTCCGGCTCTGAAAC TCCAGGTACTTCTGAAAGCGCTACTCCTGAATCCGGCCCAGGT AGCGAACCGGCTACTTCCGGCTCTGAAACCCCAGGTTCCACCA GCTCTACTGCAGAATCTCCGGGCCCAGGTTCTACTAGCTCTACT GCAGAATCTCCGGGTCCAGGTACTTCTCCTAGCGGCGAATCTTC TACCGCTCCAGGTGAACCGGCAACCTCTGGCTCTGAAACT CCAGGTAGCGAACCTGCAACCTCCGGCTCTGAAACCCCAGGTA CTTCTACTGAACCTTCTGAGGGCAGCGCACCAGGTTCTACCAGC TCTACCGCAGAATCTCCTGGTCCAGGTACCTCTACTCCGGAAAG CGGCTCTGCATCTCCAGGTTCTACTAGCGAATCCTTCTACTGGA CTGCACCAGGTACTTCTACCGAACCGTCCGAAGGCAGCGCTCC AGGTACCTCTACTGAACCTTCCGAGGGCAGCGCTCCAGGTACCT CTACCGAACCTTCTGAAGGTAGCGCACCAGGTAGCTCTACTCCG TCTGGTGCAACCGGCTCTCCAGGTTCTAGCCCGTCTGCTTCCAC TGGTACTGGCCCAGGTGCTTCCCCGGGCACCAGCTCTACTGGTT CTCCAGGTAGCGAACCTGCTACCTCCGGTTCTGAAACCCCAGGT ACCTCTGAAAGCGCAACTCCGGAGTCTGGTCCAGGTAGCCCTG CAGGTTCTCCTACCTCCACTGAGGAAGGTAGCTCTACTCCGTCT GGTGCAACCGGCTCCCCAGGTTCTAGCCCGTCTGCTTCCACTG TACTGGCCCAGGTGCTTCCCGGGCACCAGCTCTACTGGTTCTC CAGGTACCTCTGAAAGCGCTACTCCGGAGTCTGGCCCAGGTAC CTCTACTGAACCGTCTGAGGGTAGCGCTCCAGGTACTTCTACTG AACCGTCCGAAGGTAGCGCACCAGGTTTTCCGACTATTCCGCTA TTCCGTCTGTTTGATAATGCTATGCTGCGTGCGCACCGTCTGCA CCAGCTGGCCTTTGATACTTACCAGGAATTTGAAGAAGCCTACA TTCCTAAAGAGCAGAAGTACTCTTTCCTGCAAAACCCACAGACT TCTCTCTGCTTCAGCGAATCTATTCCGACGCCTTCCAATCGCGA GGAAACTCAGCAAAAGTCCAATCTGGAACTACTCCGCATTTCTC TGCTTCTGATTCAGAGCTGGCTAGAACCAGTGCAATTTCTGCGT TCCGTCTTCGCCAATAGCCTAGTTTATGGCGCATCCGACAGCAA CGTATACGATCTCCTGAAAGATCTCGAGGAAGGCATTCAGACC CTGATGGGTCGTCTCGAGGATGGCTCTCCGCGTACTGGTCAGAT CTTCAAGCAGACTTACTCTAAATTTGATACTAACAGCCACAATG ACGATGCGCTTCTAAAAAACTATGGTCTGCTGTATTGTTTTCGT AAAGATATGGACAAAGTTGAAACTTTCCTGCGTATTGTTCAGTG TCGTTCCGTTGAGGGCAGCTGTGGTTTCTAAGGtggcggctgggcccg gtgagcggcgtgccgGGTGGTAGCGAACCGGCAACTTCCGGCTCTGAA ACCCCAGGTACTTCTGAAAGCGCTACTCCTGAGTCTGGCCCAGG TAGCGAACCTGCTACCTCTGGCTCTGAAACCCCAGGTAGCCCG GCAGGTCTCCGACTTCCACCGAGGAAGGTACCTCTACTGAAC CTTCTGAGGGTAGCGCTCCAGGTAGCGAACCGGCAACCTCTGG CTCTGAAACCCCAGGTAGCGAACCTGCTACCTCCGGCTCTGAA ACTCCAGGTAGCGAACCGGCTACTTCCGGTTCTGAAACTCCAG GTACCTCTACCGAACCTTCCGAAGGCAGCGCACCAGGTACTTCT GAAAGCGCAACCCCTGAATCCGGTCCAGGTAGCGAACCGGCTA CTTCTGGCTCTGAGACTCCAGGTACTTCTACCGAACCGTCCGAA GGTAGCGCACCA | |
| AM923-hGH-MMP-17-AE144 | MAEPAGSPTSTEEGA SPGTSSTGSPGSSTPS GATGSPGSSTPSGAT GSPGTSTEPSEGSAP GSEPATSGSETPGSP AGSPTSTEEGSTSST AESPGPGSTSPESGS ASPGSTSESPSGTAP GSTSESPSGTAPGTS | 819 | ATGGCTGAACCTGCTGGCTCTCCAACCTCCACTGAGGAAGGTG CATCCCCGGGCACCAGCTCTACCGGTTCTCCAGGTAGCTCTACC CCGTCTGGTGCTACCGGCTCTCCAGGTAGCTCTACCCCGTCTGG TGCTACTGGCTCTCCAGGTACTTCTACTGAACCGTCTGAAGGCA GCGCACCAGGTAGCGAACCGGCTACTTCCGGTTCTGAAACCCC AGGTAGCCCAGCAGGTTCTCCAACTTCTACTGAAGAAGGTTCTA CCAGCTCTACCGCAGAATCTCCTGGTCCAGGTACCTCTACTCCG GAAAGCGGCTCTGCATCTCCAGGTTCTACTAGCGAATCTCCTTC TGGCACTGCACCAGGTTCTACTAGCGAATCCCCGTCTGGTACTG | 820 |

TABLE 37-continued

Exemplary GHXTEN comprising growth hormones, XTEN and cleavage sequences

| GHXTEN Name* | Amino Acid Sequence | SEQ ID NO: | DNA Nucleotide Sequence | SEQ ID NO: |
|---|---|---|---|---|
| | TPESGSASPGTSTPES | | CTCCAGGTACTTCTACTCCTGAAAGCGGTTCCGCTTCTCCAGGT | |
| | GSASPGSEPATSGSE | | ACCTCTACTCCGGAAAGCGGTTCTGCATCTCCAGGTAGCGAACC | |
| | TPGTSESATPESGPG | | GGCAACCTCCGGCTCTGAAACCCCAGGTACCTCTGAAAGCGCT | |
| | SPAGSPTSTEEGTSTE | | ACTCCTGAATCCGGCCCAGGTAGCCCGGCAGGTTCTCCGACTTC | |
| | PSEGSAPGTSESATP | | CACTGAGGAAGGTACCTCTACTGAACCTTCTGAGGGCAGCGCT | |
| | ESGPGTSTEPSEGSA | | CCAGGTACTTCTGAAAGCGCTACCCCGGAGTCCGGTCCAGGTA | |
| | PGTSTEPSEGSAPGSP | | CTTCTACTGAACCGTCCGAAGGTAGCGCACCAGGTACTTCTACC | |
| | AGSPTSTEEGTSTEPS | | GAACCGTCCGAGGGTAGCGCACCAGGTAGCCCAGCAGGTTCTC | |
| | EGSAPGTSTEPSEGS | | CTACCTCCACCGAGGAAGGTACTTCTACCGAACCGTCCGAGGG | |
| | APGTSESATPESGPG | | TAGCGCACCAGGTACTTCTACCGAACCTTCCGAGGGCAGCGCA | |
| | TSESATPESGPGTSTE | | CCAGGTACTTCTGAAAGCGCTACCCCTGAGTCCGGCCCAGGTA | |
| | PSEGSAPGTSTEPSE | | CTTCTGAAAGCGCTACTCCTGAATCCGGTCCAGGTACCTCTACT | |
| | GSAPGTSESATPESG | | GAACCTTCCGAAGGCAGCGCTCCAGGTACCTCTACCGAACCGT | |
| | PGTSTEPSEGSAPGS | | CCGAGGGCAGCGCACCAGGTACTTCTGAAAGCGCAACCCCTGA | |
| | EPATSGSETPGSPAG | | ATCCGGTCCAGGTACTTCTACTGAACCTTCCGAAGGTAGCGCTC | |
| | SPTSTEEGSSTPSGAT | | CAGGTAGCGAACCTGCTACTTCTGGTTCTGAAACCCCAGGTAGC | |
| | GSPGTPGSGTASSSP | | CCGGCTGGCTCTCCGACCTCCACCGAGGAAGGTAGCTCTACCCC | |
| | GSSTPSGATGSPGTS | | GTCTGGTGCTACTGGTTCTCCAGGTACTCCGGGCAGCGGTACTG | |
| | TEPSEGSAPGTSTEPS | | CTTCTTCCTCTCCAGGTAGCTCTACCCCTTCTGGTGCTACTGGCT | |
| | EGSAPGSEPATSGSE | | CTCCAGGTACCTCTACCGAACCGTCCGAGGGTAGCGCACCAGG | |
| | TPGSPAGSPTSTEEG | | TACCTCTACTGAACCGTCTGAGGGTAGCGCTCCAGGTAGCGAA | |
| | SPAGSPTSTEEGTSTE | | CCGGCAACCTCCGGTTCTGAAACTCCAGGTAGCCCTGCTGGCTC | |
| | PSEGSAPGASASGAP | | TCCGACTTCTACTGAGGAAGGTAGCCCGGCTGGTTCTCCGACTT | |
| | STGGTSESATPESGP | | CTACTGAGGAAGGTACTTCTACCGAACCTTCCGAAGGTAGCGC | |
| | GSPAGSPTSTEEGSP | | TCCAGGTGCAAGCGCAAGCGGCGCGCCAAGCACGGGAGGTACT | |
| | AGSPTSTEEGSTSST | | TCTGAAAGCGCTACTCCTGAGTCCGGCCCAGGTAGCCCGGCTG | |
| | AESPGPGSTSESPSGT | | GCTCTCCGACTTCCACCGAGGAAGGTAGCCCGGCTGGCTCTCCA | |
| | APGTSPSGESSTAPG | | ACTTCTACTGAAGAAGGTTCTACCAGCTCTACCGCTGAATCTCC | |
| | TPGSGTASSSPGSSTP | | TGGCCCAGGTTCTACTAGCGAATCTCCGTCTGGCACCGCACCAG | |
| | SGATGSPGSSPSAST | | GTACTTCCCCTAGCGGTAATCTTCTACTGCACCAGGTACCCCT | |
| | GTGPGSEPATSGSET | | GGCAGCGGTACCGCTTCTTCCTCTCCAGGTAGCTCTACCCCGTC | |
| | PGTSESATPESGPGS | | TGGTGCTACTGGTCTCCAGGTTCTAGCCCGTCTGCATCTACCG | |
| | EPATSGSETPGSTSST | | GTACCGGCCCAGGTAGCGAACCGGCAACCTCCGGCTCTGAACA | |
| | AESPGPGSTSSTAESP | | TCCAGGTACTTCTGAAAGCGCTACTCCGGAATCCGGCCCCAGGT | |
| | GPGTSPSGESSTAPG | | AGCGAACCGGCTACTTCCGGCTCTGAAACCCAGGTTCACCA | |
| | SEPATSGSETPGSEP | | GCTCTACTGCAGAATCTCCGGGCCCAGGTTCTACTAGCTCTACT | |
| | ATSGSETPGTSTEPSE | | GCAGAATCTCCGGGTCAGGTACTTCTCCTAGCGGCGAATCTTC | |
| | GSAPGSTSSTAESPG | | TACCGCTCAGGTAGCGAACCGGCAACCTCTGGCTCTGAAACT | |
| | PGTSTPESGSASPGST | | CCAGGTAGCGAACCTGCAACCTCCGGCTCTGAAACCCCAGGTA | |
| | SESPSGTAPGTSTEPS | | CTTCTACTGAACCTTCTGAGGGCAGCGCACCAGGTTCTACCAGC | |
| | EGSAPGTSTEPSEGS | | TCTACCGCAGAATCTCCTGGTCCAGGTACTCTACTCCGGAAAG | |
| | APGTSTEPSEGSAPG | | CGGCTCTGCATCTCCAGGTTCTACTAGCGAATCTCCTTCTGGCA | |
| | SSTPSGATGSPGSSPS | | CTGCACCAGGTACTTCTACCGAACCGTCCGAAGGCAGCGCTCC | |
| | ASTGTGPGASPGTSS | | AGGTACCTCTACTGAACCTTCCGAGGGCAGCGCTCCAGGTACCT | |
| | TGSPGSEPATSGSET | | CTACCGAACCTTCTGAAGGTAGCGCACCAGGTAGCTCTACTCCG | |
| | PGTSESATPESGPGSP | | TCTGGTGCAACCGGCTCCCCAGGTTCTAGCCCGTCTGCTTCCAC | |
| | AGSPTSTEEGSSTPS | | TGGTACTGGCCCAGGTCTTCCCCGGGCACCAGCTCTACTGGTT | |
| | GATGSPGSSPSASTG | | CTCCAGGTAGCGAACCTGCTACCTCCGGTTCTGAAACCCCAGGT | |
| | TGPGASPGTSSTGSP | | ACCTCTGAAAGCGCAACTCCGGAGTCGGTCCAGGTAGCCCTG | |
| | GTSESATPESGPGTS | | CAGGTTCTCCTACCTCCACTGAGGAAGGTAGCTCTACTCCGTCT | |
| | TEPSEGSAPGTSTEPS | | GGTGCAACCGGCTCCCCAGGTTCTAGCCCGTCTGCTTCCACTGG | |
| | EGSAPGFPTIPLSRLF | | TACTGGCCCAGGTGCTTCCCCGGGCACCAGCTCTACTGGTTCTC | |
| | DNAMLRAHRLHQL | | CAGGTACCTCTGAAAGCGCTACTCCGGAGTCTGGCCCAGGTAC | |
| | AFDTYQEFEEAYIPK | | CTCTACTGAACCGTCTGAGGGTAGCGCTCCAGGTACTTCTACTG | |
| | EQKYSFLQNPQTSLC | | AACCGTCCGAAGGTAGCGCACCAGGTTTTCCGACTATTCCGCTG | |
| | FSESIPTPSNREETQQ | | TCTCGTCTGTTTGATAATGCTATGCTGCGTGCGCACCGTCTGCA | |
| | KSNLELLRISLLLIQS | | CCAGCTGGCCTTTGATACTTACCAGGAATTTGAAGAAGCCTACA | |
| | WLEPVQFLRSVFAN | | TTCCTAAAGAGCAGAAGTACTCTTTCCTGCAAAACCCACAGACT | |
| | SLVYGASDSNVYDL | | TCTCTCTGCTTCAGCGAATCTATTCCGACGCCTTCCAATCGCGA | |
| | LKDLEEGIQTLMGRL | | GGAAACTCAGCAAAAGTCCAATCTGGAACTACTCCGCATTTCTC | |
| | EDGSPRTGQIFKQTY | | TGCTTCTGATTCAGAGCTGGCTAGAACCAGTGCAATTTCTGCGT | |
| | SKFDTNSHNDDALL | | TCCGTCTTCGCCAATACCTAGTTTATGCGCATCCGACGCAA | |
| | KNYGLLYCFRKDMD | | CGTATACGATCTCCTGAAAGATCTCGAGGAAGGCATTCAGACC | |
| | KVETFLRIVQCRSVE | | CTGATGGGTCGTCTCGAGGATGGCTCTCCGCGTACTGGTCAGAT | |
| | GSCGFGAPLGLRLR | | CTTCAAGCAGACTTACTCTAAATTTGATACTAACAGCCACAATG | |
| | GGGGSEPATSGSETP | | ACGATGCGCTTCTAAAAAACTATGGTCTGCTGTATTGTTTTCGT | |
| | GTSESATPESGPGSE | | AAAGATATGGATAAAGTTGAAACCTTCCTGCGTATTGTTCAGTG | |
| | PATSGSETPGSPAGS | | TCGTTCCGTTGAGGGCAGCTGTGGTTTCTAAGGTgcgccgctgggcctg | |
| | PTSTEEGTSTEPSEGS | | cgcctgcgcggcGGTGGTAGCGAACCGGCAACTTCCGGCTCTGAA | |
| | APGSEPATSGSETPG | | ACCCCAGGTACTTCTGAAAGCGCTACTCCTGAGTCTGGCCCAGG | |
| | SEPATSGSETPGSEP | | TAGCGAACCTGCTACCTCTGGCTCTGAAACCCCAGGTAGCCCG | |
| | ATSGSETPGTSTEPSE | | GCAGGCTCTCCGACTTCCACCGAGGAAGGTACCTCTACTGAAC | |
| | GSAPGTSESATPESG | | CTTCTGAGGGTAGCGCTCCAGGTAGCGAACCGGCAACCTCTGG | |

TABLE 37-continued

Exemplary GHXTEN comprising growth hormones, XTEN and cleavage sequences

| GHXTEN Name* | Amino Acid Sequence | SEQ ID NO: | DNA Nucleotide Sequence | SEQ ID NO: |
|---|---|---|---|---|
| | PGSEPATSGSETPGT STEPSEGSAP | | CTCTGAAACCCCAGGTAGCGAACCTGCTACCTCCGGCTCTGAA ACTCCAGGTAGCGAACCGGCTACTTCCGGTTCTGAAACTCCAG GTACCTCTACCGAACCTTCCGAAGGCAGCGCACCAGGTACTTCT GAAAGCGCAACCCCTGAATCCGGTCCAGGTAGCGAACCGGCTA CTTCTGGCTCTGAGACTCCAGGTACTTCTACCGAACCGTCCGAA GGTAGCGCACCA | |
| AM923-hGH-Thrombin-AE288 | MAEPAGSPTSTEEGA SPGTSSTGSPGSSTPS GATGSPGSSTPSGAT GSPGTSTEPSEGSAP GSEPATSGSETPGSP AGSPTSTEEGSTSST AESPGPGSTSTPESGS ASPGSTSESPSGTAP GSTSESPSGTAPGTS TPESGSASPGTSTPES GSASPGSEPATSGSE TPGTSESATPESGPG SPAGSPTSTEEGTSTE PSEGSAPGTSESATP ESGPGTSTEPSEGSA PGTSTEPSEGSAPGSP AGSPTSTEEGTSTEPS EGSAPGTSTEPSEGS APGTSESATPESGPG TSESATPESGPGTSTE PSEGSAPGTSTEPSE GSAPGTSESATPESG PGTSTEPSEGSAPGS EPATSGSETPGSPAG SPTSTEEGSSTPSGAT GSPGTPGSGTASSSP GSSTPSGATGSPGTS TEPSEGSAPGTSTEPS EGSAPGSEPATSGSE TPGSPAGSPTSTEEG SPAGSPTSTEEGTSTE PSEGSAPGASASGAP STGGTSESATPESGP GSPAGSPTSTEEGSP AGSPTSTEEGSTSST AESPGPGSTSESPSGT APGTSPSGESSTAPG TPGSGTASSSPGSSTP SGATGSPGSSPSAST GTGPGSEPATSGSET PGTSESATPESGPGS EPATSGSETPGSTSST AESPGPGSTSSTAESP GPGTSPSGESSTAPG SEPATSGSETPGSEP ATSGSETPGTSTEPSE GSAPGSTSSTAESPG PGTSTPESGSASPGST SESPSGTAPGTSTEPS EGSAPGTSTEPSEGS APGTSESATPESGPG SSTPSGATGSPGSSPS ASTGTGPGASPGTSS TGSPGSEPATSGSET PGTSESATPESGPGSP AGSPTSTEEGSSTPS GATGSPGSSPSASTG TGPGASPGTSSTGSP GTSESATPESGPGTS TEPSEGSAPGTSTEPS EGSAPGFPTIPLSRLF DNAMLRAHRLHQL AFDTYQEFEEAYIPK EQKYSFLQNPQTSLC FSESIPTPSNREETQQ KSNLELLRISLLIQS WLEPVQFLRSVFAN SLVYGASDSNVYDL | 821 | ATGGCTGAACCTGCTGGCTCTCCAACCTCCACTGAGGAAGGTG CATCCCCGGGCACCAGCTCTACCGGTTCTCCAGGTAGCTCTACC CCGTCTGGTGCTACCGGCTCTCCAGGTAGCTCTACCCCGTCTGG TGCTACTGGCTCTCCAGGTACTTCTACTGAACCGTCTGAAGGCA GCGCACCAGGTAGCGAACCGGCTACTTCCGGTTCTGAAACCCC AGGTAGCCCAGCAGGTTCTCCAACTTCTACTGAAGAAGGTTCTA CCAGCTCTACCGCAGAATCTCCTGGTCCAGGTACCTCTACTCCG GAAAGCGGCTCTGCATCTCCAGGTTCTACTAGCGAATCTCCTTC TGGCACTGCACCAGGTTCTACTAGCGAATCCCCGTCTGGTACTG CTCCAGGTACTTCTACTCCTGAAAGCGGTTCCGCTTCTCCAGGT ACCTCTACTCCGGAAAGCGGTTCTGCATCTCCAGGTAGCGAACC GGCAACCTCCGGCTCTGAAACCCCAGGTACTTCTGAAAGCGCT ACTCCTGAATCCGGCCCAGGTAGCCCGGCAGGTTCTCCGACTTC CACTGAGGAAGGTACCTCTACTGAACCTTCTGAGGGCAGCGCT CCAGGTACTTCTGAAAGCGCTACCCCGGAGTCCGGTCCAGGTA CTTCTACTGAACCGTCCGAAGGTAGCGCACCAGGTACTTCTACC GAACCGTCCGAAGGGTAGCGCACCAGGTTCTC CTACCTCCACCGAGGAAGGTACTTCTACCGAACCGTCCGAGGG TAGCGCACCAGGTACTTCTACCGAACCTTCCGAGGGCAGCGCA CCAGGTACTTCTGAAAGCGCTACCCCGGAGTCCGGCCCAGGTA CTTCTGAAAGCGCTACTCCTGAATCCGGTCCAGGTACCTCTACT GAACCTTCCGAAGGCAGCGCTCCAGGTACCTCTACCGAACCGT CCGAGGGCAGCGCACCAGGTACTTCTGAAAGCGCAACCCCTGA ATCCGGTCCAGGTACTTCTACTGAACCTTCCGAAGGTAGCGCTC CAGGTAGCGAACCTGCTACTTCTGAAACCCCAGGTAGC CCGGCTGGCTCTCCGACCTCCACCGAGGAAGGTAGCTCTACCCC GTCTGGTGCTACTGGTTCTCCAGGTACTCCGGGCAGCGGTACTG CTTCTTCCTCTCCAGGTAGCTCTACCCCTTCTGGTGCTACTGGCT CTCCAGGTACCTCTACCGAACCGTCCGAGGGTAGCGCACCAGG TACCTCTACTGAACCGTCTGAGGGTAGCGCTCCAGGTAGCGAA CCGGCAACCTCCGGCTCTGAA ACTCCAGGTAGCCCTGCTGGCTC TCCGACTTCTACTGAGGAAGGTAGCCCGGCTGGTTCTCCGACTT CTACTGAGGAAGGTACTTCTACCGAACCTTCCGAAGGTAGCGC TCCAGGTGCAAGCGCAAGCGGCGCGCCAAGCACGGGAGGTACT TCTGAAAGCGCTACTCCTGAGTCCGGCCCAGGTAGCCCGGCTG GCTCTCCGACTTCCACCGAGGAAGGTAGCCCGGCTGGCTCTCCA ACTTCTACTGAAGAAGGTTCTACCAGCTCTACCGCTGAATCTCC TGGCCCAGGTTCTACTAGCGAATCTCCGTCTGGCACCGCACCAG GTACTTCCCCTAGCGGTGAATCTTCTACTGCACCAGGTACCCCT GGCAGCGGTACCGCTTCTTCCTCTCCAGGTAGCTCTACCCCGTC TGGTGCTACTGGCTCTCCAGGTTCTAGCCCGTCTGCATCTACCG GTACCGGCCCAGGTAGCGAACCGGCAACCTCCGGCTCTGAAAC TCCAGGTACTTCTGAAAGCGCTACTCCGGAATCGGCCCAGGT AGCGAACCGGCTACTTCCGGCTCTGAAACCCAGGTTCCACCA GCTCTACTGCAGAATCTCCGGGCCCAGGTTCTACTAGCTCTACT GCAGAATCTCCTGGCCCAGGTTCTCCTAGCGGCGAATCTTC TACCGCTCCAGGTAGCGAACCGGCAACCTCTGGCTCTGAAACT CCAGGTAGCGAACCTGCAACCTCCGGCTCTGAAACCCCAGGTA CTTCTACTGAACCTTCTGAGGGCAGCGCACCAGGTTCTACCAGC TCTACCGCAGAATCTCCTGGTCCAGGTACCTCTACTCCGGAAAG CGGCTCTGCATCTCCAGGTTCTACTAGCGAATCTCCTTCTGGCA CTGCACCAGGTACTTCTACCGAACCGTCCGAAGGCAGCGCTCC AGGTACCTCTACTGAACCTTCCGAGGGCAGCGCTCCAGGTACCT CTACCGAACCTTCGAAGGTAGCGCACCAGGTAGCTCTACTCCG TCTGGTGCAACCGGCTCTCCAGGTTCTAGCCCGTCTGCTTCCACT GGTACTGGCCCAGGTGCTTCCCCGGGCACCAGCTCTACTGGTTC TCCAGGTAGCGAACCTGCTACCTCCGGTTCTGAAACCCCAGGT ACCTCTGAAAGCGCAACTCCGGAGTCGGTCCAGGTAGCCCTG CAGGTTCTCCTACCTCCACTGAGGAAGGTAGCTCTACTCCGTCT GGTGCAACCGGCTCTCCAGGTGCTTCCCCGGGCACCAGCTCTAC TGGTTCTCCAGGTGCTTCCCCGGGCACCAGCTCTACTGGTTCTC AGGTACCTCTGAAAGCGCTACTCCGGAGTCGGCCCAGGTAC CTCTGAAAGCGCTACTCCTGAATCCGGCCCAGGTTTCCGACTATTCCGACTG TCGTCTGTTTGATAATGCTATGCTGCGTGCGCACCGTCTGCA CCAGCTGGCCTTTGATACTTACCAGGAATTTGAAGAAGCcTACA TTCCTAAAGAGCAGAAGTACTCTTTCCTGCAAAACCCACAGACT TCTCTCTGCTTCAGCGAATCTATTCCGACGCCTTCCAATCGCGA | 822 |

TABLE 37-continued

Exemplary GHXTEN comprising growth hormones, XTEN and cleavage sequences

| GHXTEN Name* | Amino Acid Sequence | SEQ ID NO: | DNA Nucleotide Sequence | SEQ ID NO: |
|---|---|---|---|---|
| | LKDLEEGIQTLMGRL EDGSPRTGQIFKQTY SKFDTNSHNDDALL KNYGLLYCFRKDMD KVETFLRIVQCRSVE GSCGFGLTPRSLLVG GGGTSESATPESGPG SEPATSGSETPGTSES ATPESGPGSEPATSG SETPGTSESATPESGP GTSTEPSEGSAPGSP AGSPTSTEEGTSESA TPESGPGSEPATSGS ETPGTSESATPESGP GSPAGSPTSTEEGSP AGSPTSTEEGSTSEPS EGSAPGTSESATPES GPGTSESATPESGPG TSESATPESGPGSEP ATSGSETPGSEPATS GSETPGSPAGSPTST EEGTSTEPSEGSAPG TSTEPSEGSAPGSEP ATSGSETPGTSESAT PESGPGTSTEPSEGS AP | | GGAAACTCAGCAAAAGTCCAATCTGGAACTACTCCGCATTTCTC TGCTTCTGATTCAGAGCTGGCTAGAACCAGTGCAATTTCTGCGT TCCGTCTTCGCCAATAGCCTAGTTTATGGCGCATCCGACAGCAA CGTATACGATCTCCTGAAAGATCTCGAGGAAGGCATTCAGACC CTGATGGGTCGTCTCGAGGATGGCTCTCCGCGTACTGGTCAGAT CTTCAAGCAGACTTACTCTAAATTTGATACTAACAGCCACAATG ACGATGCGCTTCTAAAAAACTATGGTCTGCTGTATTGTTTTCGT AAAGATATGGACAAAGTTGAAACCTTCCTGCGTATTGTTCAGTG TCGTTCCGTTGAGGGCAGCTGTGGTTTCTAAGGTctgacccccgcgcagc ctgctggtgggcggcGGTGGTACCTCTGAAAGCGCAACTCCTGAGTCTG GCCCAGGTAGCGAACCTGCTACCTCCGGCTCTGAGACTCCAGG TACCTCTGAAAGCGCAACCCCGGAATCTGGTCCAGGTAGCGAA CCTGCAACCTCTGGCTCTGAAACCCCAGGTACCTCTGAAAGCGC TACTCCTGAATCTGGCCCAGGTACTTCTACTGAACCGTCCGAGG GCAGCGCACCAGGTAGCCCTGCTGGCTCTCCAACCTCCACCGA AGAAGGTACCTCCGAAAGCGCAACCCCTGAATCCGGCCCAGGT AGCGAACCGGCAACCTCCGGTTCTGAAACCCCAGGTACTTCTG AAAGCGCTACTCCTGAGTCCGGCCCAGGTAGCCCGGCTGGCTC TCCGACTTCCACCGAGGAAGGTAGCCCGGCTGGCTCTCCAACTT CTACTGAAGAAGGTACTTCTACCGAACCTTCCGAGGGCAGCGC ACCAGGTACTTCTGAAAGCGCTACCCCTGAGTCCGGCCCAGGT ACTTCTGAAAGCGCTACTCCTGAATCCGGTCCAGGTACTTCTGA AAGCGCTACCCCGGAATCTGGCCCAGGTAGCGAACCGGCTACT TCTGGTTCTGAAACCCCAGGTAGCGAACCGGCTACCTCCGGTTC TGAAACTCCAGGTAGCCCAGCAGGCTCTCCGACTTCCACTGAG GAAGGTACTTCTACTGAACCTTCGAAGGCAGCGCACCAGGTA CCTCTACTGAACCTTCTGAGGGCAGCGCTCCAGGTAGCGAACCT GCAACCTCTGGCTCTGAAACCCCAGGTACCTCTGAAAGCGCTA CTCCTGAATCTGGCCCAGGTACTTCTACTGAACCGTCCGAGGGC AGCGCACCA | |
| AM923-hGH-FXIa-AE288 | MAEPAGSPTSTEEGA SPGTSSTGSPGSSTPS GATGSPGSSTPSGAT GSPGTSTEPSEGSAP GSEPATSGSETPGSP AGSPTSTEEGSTSST AESPGPGTSTPESGS ASPGSTSESPSGTAP GSTSESPSGTAPGTS TPESGSASPGTSTPES GSASPGSEPATSGSE TPGTSESATPESGPG SPAGSPTSTEEGTSTE PSEGSAPGTSESATP ESGPGTSTEPSEGSA PGTSTEPSEGSAPGSP AGSPTSTEEGTSTEPS EGSAPGTSTEPSEGS APGTSESATPESGPG TSESATPESGPGTSTE PSEGSAPGTSTEPSE GSAPGTSESATPESG PGTSTEPSEGSAPGS EPATSGSETPGSPAG SPTSTEEGSSTPSGAT GSPGTPGSGTASSSP GSSTPSGATGSPGTS TEPSEGSAPGTSTEPS EGSAPGSEPATSGSE TPGSPAGSPTSTEEG SPAGSPTSTEEGTSTE PSEGSAPGASASGAP STGGTSESATPESGP GSPAGSPTSTEEGSP AGSPTSTEEGSTSST AESPGPGSTSESPSGT APGTSPSGESSTAPG TPGSGTASSSPGSSTP SGATGSPSGSPSAST GTGPGSEPATSGSET PGTSESATPESGPGS EPATSGSETPGSTSST AESPGPGSTSSTAESP GPGTSPSGESSTAPG | 823 | ATGGCTGAACCTGCTGGCTCTCCAACCTCCACTGAGGAAGGTG CATCCCCGGGCACCAGCTCTACCGGTTCTCCAGGTAGCTCTACC CCGTCTGGTGCTACCGGCTCTCCAGGTAGCTCTACCCCGTCTGG TGCTACTGGCTCTCCAGGTACTTCTACTGAACCGTCTGAAGGCA GCGCACCAGGTAGCGAACCGGCTACTTCCGGTTCTGAAACCCC AGGTAGCCCAGCTGGTTCTCCAACTTCTACTGAAGAAGGTTCTA CCAGCTCTACCGCAGAATCTCCTGGTCCAGGTACCTCTACTCCG GAAAGCGGCTCTGCATCTCCAGGTTCTACTAGCGAATCTCCTTC TGGCACTGCACCAGGTTCTACTAGCGAATCCCCGTCTGGTACTG CTCCAGGTACTTCTACTCCTGAAAGCGGTTCCGCTTCTCCAGGT GGATCAGCCAGCCCAGGTTCTGAACCTGCCACTTCTGGTTCTGA ACCTCTACTCCGGAAAGCGGTTCTGCATCTCCAGGTAGCGAACC GGCAACCTCCGGCTCTGAAACCCCAGGTACCTCTGAAAGCGCT ACTCCTGAATCCGGCCCAGGTAGCCCGGCAGGTTCTCCGACTTC CACTGAGGAAGGTACCTCTACTGAACCTTCTGAGGGCAGCGCT CCAGGTACTTCTGAAAGCGCTACCCCGGAGTCCGGTCCAGGTA CTTCTACTGAACCGTCCGAAGGTAGCGCACCAGGTACTTCTACC GAACCGTCCGAGGGTAGCGCACCAGGTAGCCCAGCAGGTTCT CTACCTCCACCGAGGAAGGTACTTCTACCGAACCGTCCGGGC AGCGCACCAGGTACTTCTACCGAACCTTCCGAGGGCAGCGCA CCAGGTACTTCTGAAAGCGCTACCCCTGAGTCCGGCCCAGGTA CTTCTGAAAGCGCTACTCCTGAATCCGGTCCAGGTACCTCTACT GAACCTTCCGAAGGCAGCGCTCCACCGAACCTCTACCGAACCG CCGAGGGCAGCGCACCAGGTACTTCTGAAAGCGCAACCCCTGA ATCCGGTCAGGTACTTCTACTGAACCTTCCGAAGGTAGCGCTC CAGGTAGCGAACCTGCTACTTCTGGTTCTGAAACCCCAGGTAGC CCGGCTGGCTCTCCGACCTCCACCGAGGAAGGTAGCTCTACCCC GTCTGGTGCTACTGGTTCTCCAGGTACGCGGGCAGCGGTTCTA CTTCCTCTCCAGGTAGCTCTACCCCTTCTGGTGCTACTGGCT CTCCAGGTACCTCTACCGAACCGTCCGAGGGTAGCGCACCAGG TACCTCTACTGAACCGTCGAGGGTAGCGCTCCAGGTAGCGAA CCGGCAACCTCCGGTTCTGAAACCCCAGGTAGCCCTGCTGGCTC TCCGACTTCTACTGAGGAAGGTAGCCCGGCTGGTTCTCCGACTT CTACTGAGGAAGGTACTTCTACCGAACCTTCGAAGGTAGCGC TCCGGCAACCTCTCAGGTTCTGAAACCCCAGGTAGCCTGGCTC TCCGGTGCAAGCGCAAGCGGCGCGCAAGCACGGGAGGTACT TCTGAAAGCGCTACTCCTGAGTCCGGCCCCAGGTAGCCCGGCTC GCTCTCCGACTTCCACCGAGGAAGGTAGCCCGGCTGGCTCTCCA ACTTCTACTGAAGAAGGTTCTACCAGCTCTACCGCTGAATCTCC TGGCCCAGGTTCTACTAGCGAATCTCCGTCTGGCACCGCACCAG GTACTTCCCCTAGCGGTGAATCTTCTACTGCACCAGGTACCCCT GGCAGCGGTACCGCTTCTTCCTCTCCAGGTAGCTCTACCCCGTC TGGTGCTACTGGCTCTCCAGGTTCTAGCCCGTCTGCATCTACCG GTACCGGCCCAGGTAGCGAACCGGCAACCTCCGGCTCTGAAAC TCCAGGTACTTCTGAAAGCGCTACTCCGGAATCCGGCCCCAGGT AGCGAACCGGCTACTTCCGGCTCTGAAACCCCAGGTTCCACCA | 824 |

TABLE 37-continued

Exemplary GHXTEN comprising growth hormones, XTEN and cleavage sequences

| GHXTEN Name* | Amino Acid Sequence | SEQ ID NO: | DNA Nucleotide Sequence | SEQ ID NO: |
|---|---|---|---|---|
| | SEPATSGSETPGSEP ATSGSETPGTSTEPSE GSAPGSTSSTAESPG PGTSTPESGSASPGST SESPSGTAPGTSTEPS EGSAPGTSTEPSEGS APGTSTEPSEGSAPG SSTPSGATGSPGSSPS ASTGTGPGASPGTSS TGSPGSEPATSGSET PGTSESATPESGPGSP AGSPTSTEEGSSTPS GATGSPGSSPSASTG TGPGASPGTSSTGSP GTSESATPESGPGTS TEPSEGSAPGTSTEPS EGSAPGFPTTPLSRLF DNAMLRAHRLHQL AFDTYQEFEEAYIPK EQKYSFLQNPQTSLC FSESIPTPSNREETQQ KSNLELLRISLLLIQS WLEPVQFLRSVFAN SLVYGASDSNVYDL LKDLEEGIQTLMGRL EDGSPRTGQIFKQTY SKFDTNSHNDDALL KNYGLLYCFRKDMD KVETFLRIVQCRSVE GSCGFGGGKLTRVV GGGGTSESATPESGP GSEPATSGSETPGTS ESATPESGPGSEPAT SGSETPGTSESATPES GPGTSTEPSEGSAPG SPAGSPTSTEEGTSES ATPESGPGSEPATSG SETPGTSESATPESGP GSPAGSPTSTEEGSP AGSPTSTEEGTSTEPS EGSAPGTSESATPES GPGTSESATPESGPG TSESATPESGPGSEP ATSGSETPGSEPATS GSETPGSPAGSPTST EEGTSTEPSEGSAPG TSTEPSEGSAPGSEP ATSGSETPGTSESAT PESGPGTSTEPSEGS AP | | GCTCTACTGCAGAATCTCCGGGCCCAGGTTCTACTAGCTCTACT GCAGAATCTCCGGGTCCAGGTACTTCTCCTAGCGGCGAATCTTC TACCGCTCCAGGTAGCGAACCGGCAACCTCTGGCTCTGAAACT CCAGGTAGCGAACCTGCAACCTCCGGCTCTGAAACCCCAGGTA CTTCTACTGAACCTTCTGAGGGCAGCGCACCAGGTTCTACCAGC TCTACCGCAGAATCTCCTGGTCCAGGTACCTCTACTCCGGAAAG CGGCTCTGCATCTCCAGGTTCTACTAGCGAATCTCCTTCTGGCA CTGCACCAGGTACTTCTACCGAACCGTCCGAAGGCAGCGCTCC AGGTACCTCTACTGAACCTTCCGAGGGCAGCGCTCCAGGTACCT CTACCGAACCTTCTGAAGGTAGCGCACCAGGTAGCTCTACTCCG TCTGGTGCAACCGGCTCCCCAGGTTCTAGCCCGTCTGCTTCCAC TGGTACTGGCCCAGGTGCTTCCCCGGGCACCAGCTCTACTGGTT CTCCAGGTAGCGAACCTGCTACCTCCGGTTCTGAAACCCCAGGT ACCTCTGAAAGCGCAACTCCGGAGTCTGGTCCAGGTAGCCCTG CAGGTTCTCCTACCTCCACTGAGGAAGGTAGCTCTACTCCGTCT GGTGCAACCGGCTCTCCAGGTTCTAGCCCGTCTGCTTCCACTGG TACTGGCCCAGGTGCTTCCCCGGGCACCAGCTCTACTGGTTCTC CAGGTACCTCTGAAAGCGCTACTCCGGAGTCTGGCCCAGGTAC CTCTACTGAACCGTCTGAGGGTAGCGCTCCAGGTACTTCTACTG AACCGTCCGAAGGTAGCGCACCAGGTTTTCCGACTATTCCGCTG TCTCGTCTGTTTGATAATGCTATGCTGCGTGCGCACCGTCTGCA CCAGCTGGCCTTTGATACTTACCAGGAATTTGAAGAAGCCTACA TTCCTAAAGAGCAGAAGTACTCTTTCCTGCAAAACCCACAGACT TCTCTCTGCTTCAGCGAATCTATTCCGACGCCTTCCAATCGCGA GGAAACTCAGCAAAAGTCCAATCTGGAACTACTCCGCATTTCTC TGCTTCTGATTCAGAGCTGGCTAGAACCAGTGCAATTTCTGCGT TCCGTCTTCGCCAATAGCCTAGTTTATGGCGCATCCGACAGCAA CGTATACGATCTCCTGAAAGATCTCGAGGAAGGCATTCAGACCT CTGATGGGTCGTCTCGAGGATGGCTCTCCGCGTACTGGTCAGAT CTTCAAGCAGACTTACTCTAAATTTGATACTAACAGCCACAATG ACGATGCGCTTCTAAAAAACTATGGTCTGCTGTATTGTTTCGT AAAGATATGGACAAAGTTGAAACCTTCCTGCGTATTGTTCAGTG TCGTTCCGTTGAGGGCAGCTGTGGTTTCTAAGGTggcggcaaactgacc cgcgtggtgggcggcGGTGGTACCTCTGAAAGCGCAACTCCTGAGTCT GGCCCAGGTAGCGAACCTGCTACCTCCGGCTCTGAGACTCCAG GTACCTCTGAAAGCGCAACCCCGGAATCTGGTCCAGGTAGCGA ACCTGCAACCTCTGGCTCTGAAACCCCAGGTACCTCTGAAGGC GCTACTCCTGAATCTGGCCCAGGTACTTCTACTGAACCGTCCGA GGGCAGCGCACCAGGTAGCCCTGCTGGCTCTCCAACCTCCACC GAAGAAGGTACCTCTGAAAGCGCAACCCCTGAATCCGGCCCAG GTAGCGAACCTCTCGAAACCCCAGGTACTTCT GAAAGCGCTACTCCTGAGTCGGCCCAGGTAGCCCGGCTGGCT CTCCGACTTCCACCGAGGAAGGTAGCCCGGCTGGCTCTCCAACT TCTACTGAAGAAGGTACTTCTACCGAACCTTCCGAGGGCAGCG CACCGGGTACTTCTGAAAGCGCGGCCGG TACTTCTGAAAGCGCTACTCCTGAATCCGGTCCAGGTACTTCTG AAAGCGCTACCCCGGAATCTGGCCCAGGTAGCGAACCGGCTAC TTCTGGTTCTGAAACCCCAGGTAGCGAACCGGCTACCTCCGGTT CTGAAACTCCAGGTAGCCCAGCAGGCTCTCCGACTTCCACTGA GGAAGGTACTTCTACTGAACCTTCCGAAGGCAGCGCACCAGGT ACCTCTACTGAACCTTCTGAGGGCAGCGCTCCAGGTAGCGAAC CTGCAACCTCTGGCTCTGAAACCCCAGGTACCTCTGAAAGCGCT ACTCCTGAATCTGGCCCAGGTACTTCTACTGAACCGTCCGAGGG CAGCGCACCA | |
| AM923- hGH- Elastase- AE288 | MAEPAGSPTSTEEGA SPGTSSTGSPGSSTPS GATGSPGSSTPSGAT GSPGTSTEPSEGSAP GSEPATSGSETPGSP AGSPTSTEEGSTSST AESPGPGTSTPESGS ASPGSTSESPSGTAP GSTSESPSGTAPGTS TPESGSASPGTSTPES GSASPGSEPATSGSE TPGTSESATPESGPG SPAGSPTSTEEGTSTE PSEGSAPGTSESATP ESGPGTSTEPSEGSA PGTSTEPSEGSAPGSP AGSPTSTEEGTSTEPS EGSAPGTSTEPSEGS APGTSESATPESGPG TSESATPESGPGTSTE | 825 | ATGGCTGAACCTGCTGGCTCTCCAACCTCCACTGAGGAAGGTG CATCCCCGGGCACCAGCTCTACCGGTTCTCCAGGTAGCTCTACC CCGTCTGGTGCTACCGGCTCTCCAGGTAGCTCTACCCCGTCTGG TGCTACTGGCTCTCCAGGTACTTCTACTGAACCGTCTGAAGGCA GCGAACCAGGTAGCGAACCGGCTACTTCCGGTTCTGAAACCCC AGGTAGCCCAGCAGGTTCTCCAACTTCTACTGAAGAAGGTTCTA CCAGCTCTACCGCAGAATCTCCTGGTCCAGGTACCTCTACTCCG GAAAGCGGCTCTGCATCTCCAGGTTCTACTAGCGAATCTCCTTC TGGCACTGCACCAGGTTCTACTAGCGAATCCCCGTCTGGTACTG CTCCAGGTACTTCTACTCCTGAAAGCGGTTCCGCTTCTCCAGGT ACCTCTACTCCGGAATCTGGTTCTGCATCTCCAGGTAGCGAACC AGCAACCTCCGGCTCTGAAACCCCAGGTACCTCTGAAAGCGCT ACTCCTGAATCCGGCCCAGGTAGCCCGGCAGGTTCTCCGACTTC CACTGAGGAAGGTACCTCTACTGAACCTTCTGAGGGCAGCGCT CCAGGTACTTCTGAAAGCGCTACCCCGGAGTCCGGTCCAGGTA CTTCTACTGAACCGTCCGAAGGTAGCGCACCAGGTACTTCTACC GAACCGTCCGAGGGTAGCGCACCAGGTAGCCCAGCAGGTTCTC CTACCTCCACCGAGGAAGGTACTTCTACCGAACCGTCCGAGGG CAGCGCACCAGGTACTTCTACCGAACCGTCCGAGGGCAGCGCA CCAGGTACTTCTGAAAGCGCTACCCCTGAGTCCGGCCCAGGTA | 826 |

TABLE 37-continued

Exemplary GHXTEN comprising growth hormones, XTEN and cleavage sequences

| GHXTEN Name* | Amino Acid Sequence | SEQ ID NO: | DNA Nucleotide Sequence | SEQ ID NO: |
|---|---|---|---|---|
| | PSEGSAPGTSTEPSE | | CTTCTGAAAGCGCTACTCCTGAATCCGGTCCAGGTACCTCTACT | |
| | GSAPGTSESATPESG | | GAACCTTCCGAAGGCAGCGCTCCAGGTACCTCTACCGAACCGT | |
| | PGTSTEPSEGSAPGS | | CCGAGGGCAGCGCACCAGGTACTTCTGAAAGCGCAACCCCTGA | |
| | EPATSGSETPGSPAG | | ATCCGGTCCAGGTACTTCTACTGAACCTTCCGAAGGTAGCGCTC | |
| | SPTSTEEGSSTPSGAT | | CAGGTAGCGAACCTGCTACTTCTGGTTCTGAAACCCCAGGTAGC | |
| | GSPGTPGSGTASSSP | | CCGGCTGGCTCTCCGACCTCCACCGAGGAAGGTAGCTCTACCCC | |
| | GSSTPSGATGSPGTS | | GTCTGGTGCTACTGGTTCTCCAGGTACTCCGGGCAGCGGTACTG | |
| | TEPSEGSAPGTSTEPS | | CTTCTTCCTCTCCAGGTAGCTCTACCCCTTCTGGTGCTACTGGCT | |
| | EGSAPGSEPATSGSE | | CTCCAGGTACCTCTACCGAACCGTCCGAGGGTAGCGCACCAGG | |
| | TPGSPAGSPTSTEEG | | TACCTCTACTGAACCGTCTGAGGGTAGCGCTCCAGGTAGCGAA | |
| | SPAGSPTSTEEGTSTE | | CCGGCAACCTCCGGTTCTGAAACTCCAGGTAGCCCTGCTGGCTC | |
| | PSEGSAPGASASGAP | | TCCGACTTCTGAGGAAGGTAGCCCGGCTGGTTCTCCGACTT | |
| | STGGTSESATPESGP | | CTACTGAGGAAGGTACTTCTACCGAACCTTCCGAAGGTAGCGC | |
| | GSPAGSPTSTEEGSP | | TCCAGGTGCAAGCGCAAGCGGCGCGCCAAGCACGGGAGGTACT | |
| | AGSPTSTEEGSTSST | | TCTGAAAGCGCTACTCCTGAGTCCGGCCCAGGTAGCCCGGCTG | |
| | AESPGPGSTSESPSGT | | GCTCTCCGACTTCTCACCGAGGAAGGTAGCCCGGCTGGCTCTCCA | |
| | APGTSPSGESSTAPG | | ACTTCTACTGAAGAAGGTTCTACCAGCTCTACCGCTGAATCTCC | |
| | TPGSGTASSSPGSSTP | | TGGCCCAGGTTCTACTAGCGAATCTCCGTCTGGCACCGCACCAG | |
| | SGATGSPGSSPSAST | | GTACTTCCCCTAGCGGTGAATCTTCTACTGCACCAGGTACCCCT | |
| | GTGPGSEPATSGSET | | GGCAGCGGTACCGCTTCTTCCTCCAGGTAGCTCTACCCCGTC | |
| | PGTSESATPESGPGS | | TGGTGCTACTGGCTCTCCAGGTTCTAGCCCGTCTGCATCTACCG | |
| | EPATSGSETPGSTSST | | GTACCGGCCCAGGTAGCGAACCGGCAACCTCCGGCTCTGAAAC | |
| | AESPGPGSTSSTAESP | | TCCAGGTACTTCTGAAAGCGCTACTCCGGAATCCGGCCCAGGT | |
| | GPGTSPSGESSTAPG | | AGCGAACCGGCTACTTCCGGCTCTGAAACCCCAGGTTCCACCA | |
| | SEPATSGSETPGSEP | | GCTCTACTGACTACTACTCCCGGGCCCAGGTTCTACTAGCTCTACT | |
| | ATSGSETPGTSTEPSE | | GCAGAATCTCCGGGTCCAGGTACTTCTCCTAGCGGCGAATCTTC | |
| | GSAPGSTSSTAESPG | | TACCGCTCCAGGTAGCGAACCGGCAACCTCTGGCTCTGAAACT | |
| | PGTSTPESGSASPGST | | CCAGGTAGCGAACCTGCAACCTCCGGCTCTGAAACCCCAGGTA | |
| | SESPSGTAPGTSTEPS | | CTTCTACTGAACCTTCTGAGGGCAGCGCACCAGGTTCTACCAGC | |
| | EGSAPGTSTEPSEGS | | TCTACCGCAGAATCTCCTGGTCCAGGTACCTCTACTCCGGAAAG | |
| | APGTSTEPSEGSAPG | | CGGCTCTGCATCTCCAGGTTCTACTAGCGAATCTCCTTCTGGCA | |
| | SSTPSGATGSPGSSPS | | CTGCACCAGGTACTTCTACCGAACCGTCCGAAGGCAGCGCTCC | |
| | ASTGTGPGASPGTSS | | AGGTACCTCTACTGAACCTTCCGAGGGCAGCGCTCCAGGTACCT | |
| | TGSPGSEPATSGSET | | CTACCGAACCTTCTGAAGGTAGCGCACCAGGTAGCTCTACTCCG | |
| | PGTSESATPESGPGSP | | TCTGGTGCAACCGGCTCCCCAGGTTCTAGCCCGTCTGCTTCCAC | |
| | AGSPTSTEEGSSTPS | | TGGTACTGGCCCAGGTGCTTCCCCGGGCACCAGCTCTACTGGTT | |
| | GATGSPGSSPSASTG | | CTCCAGGTAGCGAACCTGCTACCTCCGGTTCTGAAACCCCAGGT | |
| | TGPGASPGTSSTGSP | | ACCTCTGAAAGCGCAACTCCGGAGTCTGGTCCAGGTAGCCCTG | |
| | GTSESATPESGPGTS | | CAGGTTCTCCTACCTCCACTGAGGAAGGTAGCTCTACTCCGTCT | |
| | TEPSEGSAPGTSTEPS | | GGTGCAACCGGCTCCCAGGTTCTAGCCCGTCTGCTTCCACTGG | |
| | EGSAPGFPTIPLSRLF | | TACTGGCCCAGGTGCTTCCCCGGGCACCAGCTCTACTGGTTCTC | |
| | DNAMLRAHRLHQL | | CAGGTACCTCTGAAAGCGCTACTCCGGAGTCTGGCCCAGGTAC | |
| | AFDTYQEFEEAYIPK | | CTCTACTGAACCGTCTGAGGGTAGCGCTCCAGGTACTTCTACTG | |
| | EQKYSFLQNPQTSLC | | AACCGTCCGAAGGTAGCGCACCAGGTTTTCCGACTATTCCGCTG | |
| | FSESIPTPSNREETQQ | | TCTCGTCTGTTTGATAATGCTATGCTGCGTGCGCACCGTCTGCA | |
| | KSNLELLRISLLLIQS | | CCAGCTGGCCTTTGATACTTACCAGGAATTTGAAGAAGCCTACA | |
| | WLEPVQFLRSVFAN | | TTCCTAAAGAGCAGAAGTACTCTTTCCTGCAAAACCCACAGACT | |
| | SLVYGASDSNVYDL | | TCTCTCTGCTTCAGCGAATCTATTCCGACGCCTTCCAATCGCGA | |
| | LKDLEEGIQTLMGRL | | GGAAACTCAGCAAAAGTCCAATCTGGAACTACTCCGCATTTCTC | |
| | EDGSPRTGQIFKQTY | | TGCTTCTGATTCAGAGCTGGCTAGAACCAGTGCAATTTCTGCGT | |
| | SKFDTNSHNDDALL | | TCCGTCTTCGCCAATAGCCTAGTTTATGGCGCATCCGACAGCAA | |
| | KNYGLLYCFRKDMD | | CGTATACGATCTCCTGAAAGATCTCGAGGAAGGCATTCAGACC | |
| | KVETFLRIVQCRSVE | | CTGATGGGTCGTCTCGAGGATGGCTCTCCGCGTACTGGTCAGAT | |
| | GSCGFGGGLGPVSG | | CTTCAAGCAGACTTACTCTAAATTTGATACTAACAGCCACAATG | |
| | VPGGTSESATPESGP | | ACGATGCGCTTCTAAAAAACTATGGTCTGCTGTATTGTTTCGT | |
| | GSEPATSGSETPGTS | | AAAGATATGGACAAGTTGAAACCTTCCTGCGTATTGTTCAGTG | |
| | ESATPESGPGSEPAT | | TCGTTCCGTTGAGGGCAGCTGTGGTTTCTAAGGTggcggcctgggcccg | |
| | SGSETPGTSESATPES | | gtgagcggcgtgccgGGTGGTACCTCTGAAAGCGCAACTCCTGAGTCTG | |
| | GPGTSTEPSEGSAPG | | GCCCAGGTAGCGAACCTGCTACCTCCGGCTCTGAGACTCCAGG | |
| | SPAGSPTSTEEGTSES | | TACCTCTGAAAGCGCAACCCCGGAATCTGGTCCAGGTAGCGAA | |
| | ATPESGPGSEPATSG | | CCTGCAACCTCTGGCTCTGAAACCCAGGTACCTCTGAAAGCG | |
| | SETPGTSESATPESGP | | TACTCCTGAATCTGGCCCAGGTACTTCTACTGAACCGTCCGAGG | |
| | GSPAGSPTSTEEGSP | | GCAGCGCACCAGGTAGCCCTGCTGGCTCTCCAACCTCCACCGA | |
| | AGSPTSTEEGTSTEPS | | AGAAGGTACCTCTGAAAGCGCAACCCCTGAATCCGGCCCAGGT | |
| | EGSAPGTSESATPES | | AGCGAACCGGCAACCTCCGGTTCTGAAACCCAGGTACTTCT | |
| | GPGTSESATPESGPG | | AAAGCGCTACTCCTGAGTCCGGCCCAGGTAGCCCGGCTGGCTC | |
| | TSESATPESGPGSEP | | TCCGACTTCCACCGAGGAAGGTAGCCCGGCTGGCTCTCCAACTT | |
| | ATSGSETPGSEPATS | | CTACTGAAGAAGGTACTTCTACCGAACCTTCCGAGGGCAGCGC | |
| | GSETPGSPAGSPTST | | ACCAGGTACTTCTGAAAGCGCTACCCCTGAGTCCGGCCCAGGT | |
| | EEGTSTEPSEGSAPG | | ACTTCTGAAAGCGCTACTCCTGAATCCGGTCCAGGTACCTCTGA | |
| | TSTEPSEGSAPGSEP | | AAGCGCTACCCCGGAATCTGGCCCAGGTAGCGAACCGGCTACT | |
| | ATSGSETPGTSESAT | | TCTGGTTCTGAAACCCAGGTAGCGAACCGGCTACCTCCGGTTC | |

TABLE 37-continued

Exemplary GHXTEN comprising growth hormones, XTEN and cleavage sequences

| GHXTEN Name* | Amino Acid Sequence | SEQ ID NO: | DNA Nucleotide Sequence | SEQ ID NO: |
|---|---|---|---|---|
| | PESGPGTSTEPSEGS AP | | TGAAACTCCAGGTAGCCCAGCAGGCTCTCCGACTTCCACTGAG GAAGGTACTTCTACTGAACCTTCCGAAGGCAGCGCACCAGGTA CCTCTACTGAACCTTCTGAGGGCAGCGCTCCAGGTAGCGAACCT GCAACCTCTGGCTCTGAAACCCCAGGTACCTCTGAAAGCGCTA CTCCTGAATCTGGCCCAGGTACTTCTACTGAACCGTCCGAGGGC AGCGCACCA | |
| AM923-hGH-MMP-17-AE288 | MAEPAGSPTSTEEGA SPGTSSTGSPGSSTPS GATGSPGSSTPSGAT GSPGTSTEPSEGSAP GSEPATSGSETPGSP AGSPTSTEEGSTSST AESPGPGSTSTPESGS ASPGSTSESPSGTAP GSTSESPSGTAPGTS TPESGSASPGTSTPES GSASPGSEPATSGSE TPGTSESATPESGPG SPAGSPTSTEEGTSTE PSEGSAPGTSESATP ESGPGTSTEPSEGSA PGTSTEPSEGSAPGSP AGSPTSTEEGTSTEPS EGSAPGTSTEPSEGS APGTSESATPESGPG TSESATPESGPGTSTE PSEGSAPGTSTEPSE GSAPGTSESATPESG PGTSTEPSEGSAPGS EPATSGSETPGSPAG SPTSTEEGSSTPSGAT GSPGTPGSGTASSSP GSSTPSGATGSPGTS TEPSEGSAPGTSTEPS EGSAPGSEPATSGSE TPGSPAGSPTSTEEG SPAGSPTSTEEGTSTE PSEGSAPGASASGAP STGGTSESATPESGP GSPAGSPTSTEEGSP AGSPTSTEEGSTSST AESPGPGSTSESPSGT APGTSPSGESSTAPG TPGSGTASSSPGSSTP SGATGSPGSSPSAST GTGPGSEPATSGSET PGTSESATPESGPGS EPATSGSETPGSTSST AESPGPGSTSSTAESP GPGTSPGSESSTAPG SEPATSGSETPGSEP ATSGSETPGTSTEPSE GSAPGSTSSTAESPG PGTSTPESGSASPGST SESPSGTAPGTSTEPS EGSAPGTSTEPSEGS APGTSESATPESGPGSP AGSPTSTEEGSSTPS GATGSPGSSPSASTG TGPGASPGTSSTGSP GTSESATPESGPGTS TEPSEGSAPGTSTEPS EGSAPGFPTIPLSRLF DNAMLRAHRLHQL AFDTYQEFEEAYIPK EQKYSFLQNPQTSLC FSESIPTPSNREETQQ KSNLELLRISLLLIQS WLEPVQFLRSVFAN SLVYGASDSNVYDL | 827 | ATGGCTGAACCTGCTGGCTCTCCAACCTCCACTGAGGAAGGTG CATCCCCGGGCACCAGCTCTACCGGTTCTCCAGGTAGCTCTACC CCGTCTGGTGCTACCGGCTCTCCAGGTAGCTCTACCCCGTCTGG TGCTACTGGCTCTCCAGGTACTTCTACTGAACCGTCTGAAGGCA GCGAACCAGGTAGCGAACCGGCTAGTTCTGAAACCCCA AGGTAGCCCAGCAGGTTCTCCAACTTCTACTGAAGAAGGTTCTA CCAGCTCTACCGCAGAATCTCCTGGTCCAGGTACCTCTACTCCG GAAAGCGGCTCTGCATCTCCAGGTTCTACTAGCGAATCTCCTTC TGGCACTGCACCAGGTTCTACTAGCGAATCCCCGTCTGGTACTG CTCCAGGTACTTCTACTCCTGAAAGCGGTTCCGCTTCTCCAGGT ACCTCTACTCCGGAAAGCGGTTCTGCATCTCCAGGTAGCGAACC GCAACCTCCGGCTCTGAAACCCCAGGTACCTCTGAAAGCGCT ACTCCTGAATCTGGCCCAGGTTCTCCGGCAGGTTCTCCGACTTC CACTGAGGAAGGTACCTCTACTGAACCTTCTGAGGGCAGCGCT CCAGGTACTTCTGAAAGCGCTACCCCGGAGTCCGGTCCAGGTA CTTCTACTGAACCGTCCGAAGGTAGCGCACCAGGTACTTCTACC GAACCGTCCGAGGGTAGCGCACCAGGTTCTC CTACCTCCACCGAGGAAGGTACTTCTACCGAACCGTCCGAGGG TAGCGCACCAGGTACTTCTACCGAACCTTCCGAGGGCAGCGCA CCAGGTACTTCTGAAAGCGCTACCCCGGAGTCCGGCCCAGGTA CTTCTGAAAGCGCTACTCCTGAATCCGGTCCAGGTACCTCTACT CCGGAAAGCGGTTCTGCACCAGGTACCTCTGAAAGCGCAACCCCTGA AACCTTCCGAAGGCAGCGCTCCAGGTACTTCTACCGAACCGT CCGAGGGCAGCGCACCAGGTACTTCTGAAAGCGCAACCCCTGA ATCCGGTCCAGGTACTTCTACTGAACCTTCCGAAGGTAGCGCTC CAGGTAGCGAACCTGCTACTTCTGAAACCCCAGGTAGC CCGGCTGGCTCTCCGACCTCCACCGAGGAAGGTAGCTCTACCCC GTCTGGTGCTACTGGTTCTCCAGGTACTCCGGGCAGCGGTACTG CTTCTTCCTCTCCAGGTAGCTCTACCCCTTCTGGTGCTACTGGCT CTCCAGGTACCTCTACCGAACCGTCCGAGGGTAGCGCACCAGG TACCTCTACTGAACCGTCTGAGGGCAGCGCTCCAGGTAGCGAA CCGGCAACCTCCGGCTCTGAAACTCCAGGTTCTACTAGCTCTACCGCTGAATCTCC TGGTCCAGGTACTTCTCCGGGTGAATCTTCTACTGCACCAGGTA GCGAACCGGCTACTTCCGGCTCTGAAACCCCAGGTTCCACCA GCTCTACTGCAGAATCTCCGGGCCCAGGTTCTACTAGCTCTACT GCAGAATCTCCTCCTAGCGGCGAATCTTC TACCGCTCCAGGTAGCGAACCGGCAACCTCTGGCTCTGAAACT CCAGGTAGCGAACCTGCAACCTCCGGCTCTGAAACCCCAGGTA CTTCTACTGAACCTTCTGAGGGCAGCGCACCAGGTTCTACCAGC TCTACCGCAGAATCTCCTGGTCCAGGTACCTCTACTCCGGAAAG CGGCTCTGCATCTCCAGGTTCTACTAGCGAATCTCCTTCTGGTA CTGCACCAGGTACTTCTACCGAACCGTCCGAAGGCAGCGCTCC AGGTACCTCTACTGAACCTTCCGAGGGCAGCGCTCCAGGTACCT CTACCGAACCTTCCGAAGGTAGCGCACCAGGTAGCTCTACTCCG TCTGGTGCAACCGGTTCTCCAGGGTCTGCTTCCACTGG TGGTACTGGCCCAGGTGCTTCCCCGGGCACCAGCTCTACTGGTT CTCCAGGTAGCGAACCTGCTACCTCCGGTTCTGAAACCCCAGGT ACCTCTGAAAGCGCAACTCCGGAGTCGGTCCAGGTAGCCCTG CAGGTTCTCCTACCTCCACTGAGGAAGGTAGCTCTACTCCGTCT GGTGCAACCGGCTCCCCAGGTTCTAGCCCGTCTGCTTCCACTGG TACTGGCCCAGGTGCTTCCCCGGGCACCAGCTCTACTGGTTCTC CAGGTACCTCTGAAAGCGCTACTCCGGAGTCGGCCCAGGTAC CTCTGAAAGCGGTTCTACCCCGTCTGCTTCCACTGG AACCGTCCGAAGGTAGCGCACCAGGTTTTCCGACTATTCCACTG TCGTCTGTTTGATAATGCTATGCTGCGTGCGCACCGTCTGCA CCAGCTGGCCTTTGATACTTACCAGGAATTTGAAGAAGCcTACA TTCCTAAAGAGCAGAAGTACTCTTTCCTGCAAAACCCACAGACT TCTCTCTGCTTCAGCGAATCTATTCCGACGCCTTCCAATCGCGA | 828 |

TABLE 37-continued

Exemplary GHXTEN comprising growth hormones, XTEN and cleavage sequences

| GHXTEN Name* | Amino Acid Sequence | SEQ ID NO: | DNA Nucleotide Sequence | SEQ ID NO: |
|---|---|---|---|---|
| | LKDLEEGIQTLMGRL EDGSPRTGQIFKQTY SKFDTNSHNDDALL KNYGLLYCFRKDMD KVETFLRIVQCRSVE GSCGFGAPLGLRLR GGGGTSESATPESGP GSEPATSGSETPGTS ESATPESGPGSEPAT SGSETPGTSESATPES GPGTSTEPSEGSAPG SPAGSPTSTEEGTSES ATPESGPGSEPATSG SETPGTSESATPESGP GSPAGSPTSTEEGSP AGSPTSTEEGTSTEPS EGSAPGTSESATPES GPGTSESATPESGPG TSESATPESGPGSEP ATSGSETPGSEPATS GSETPGSPAGSPTST EEGTSTEPSEGSAPG TSTEPSEGSAPGSEP ATSGSETPGTSESAT PESGPGTSTEPSEGS AP | | GGAAACTCAGCAAAAGTCCAATCTGGAACTACTCCGCATTTCTC TGCTTCTGATTCAGAGCTGGCTAGAACCAGTGCAATTTCTGCGT TCCGTCTTCGCCAATAGCCTAGTTTATGGCGCATCCGACAGCAA CGTATACGATCTCCTGAAAGATCTCGAGGAAGGCATTCAGACC CTGATGGGTCGTCTCGAGGATGGCTCTCCGCGTACTGGTCAGAT CTTCAAGCAGACTTACTCTAAATTTGATACTAACAGCCACAATG ACGATGCGCTTCTAAAAAACTATGGTCTGCTGTATTGTTTTCGT AAAGATATGGACAAAGTTGAAACCTTCCTGCGTATTGTTCAGTG TCGTTCCGTTGAGGGCAGCTGTGGTTTCTAAGGTgcgccgctgggcctg cgcctgcgcggcggcGGTGGTACCTCTGAAAGCGCAACTCCTGAGTCT GGCCCAGGTAGCGAACCTGCTACCTCCGGCTCTGAGACTCCAG GTACCTCTGAAAGCGCAACCCCGGAATCTGGTCCAGGTAGCGA ACCTGCAACCTCTGGCTCTGAAACCCCAGGTACCTCTGAAAGC GCTACTCCTGAATCTGGCCCAGGTACTTCTACTGAACCGTCCGA GGGCAGCGCACCAGGTAGCCCTGCTGGCTCTCCAACCTCCACC GAAGAAGGTACCTCTGAAAGCGCAACCCCTGAATCCGGCCCAG GTAGCGAACCGGCAACCTCCGGTTCTGAAACCCCAGGTACTTCT GAAAGCGCTACTCCTGAGTCCGGCCCAGGTAGCCCGGCTGGCT CTCCGACTTCCACCGAGGAAGGTAGCCCGGCTGGCTCTCCAACT TCTACTGAAGAAGGTACTTCCGAACCTTCCGAGGGCAGCG CACCAGGTACTTCTGAAAGCGCTACCCCTGAGTCCGGCCCAGG TACTTCTGAAAGCGCTACTCCTGAATCCGGTCCAGGTACTTCTG AAAGCGCTACCCCGGAATCTGGCCCAGGTAGCGAACCGGCTAC TTCTGGTTCTGAAACCCCAGGTAGCGAACCGGCTACCTCCGGTT CTGAAACTCCAGGTAGCCCAGCAGGCTCTCCGACTTCCACTGA GGAAGGTACTTCTACTGAACCTTCCGAAGGCAGCGCACCAGGT ACCTCTACTGAACCTTCTGAGGGCAGCGCTCCAGGTAGCGAAC CTGCAACCTCTGGCTCTGAAACCCCAGGTACCTCTGAAAGCGCT ACTCCTGAATCTGGCCCAGGTACTTCTACTGAACCGTCCGAGGG CAGCGCACCA | |
| AE624-hGH-Thrombin-AE144 | MAEPAGSPTSTEEGT PGSGTASSSPGSSTPS GATGSPGASPGTSST GSPGSPAGSPTSTEE GTSESATPESGPGTS TEPSEGSAPGSPAGS PTSTEEGTSTEPSEGS APGTSTEPSEGSAPG TSESATPESGPGSEP ATSGSETPGSPAGSPT STEEGTSTEPSEGSAP GSPAGSPTSTEEGTSE PSEGSAPGSPAGSPT STEEGTSTEPSEGSAP GTSTEPSEGSAPGTS ESATPESGPGTSTEPS EGSAPGTSESATPES GPGSEPATSGSETPG TSTEPSEGSAPGTSTE PSEGSAPGTSESATP ESGPGTSESATPESG PGSPAGSPTSTEEGT SESATPESGPGSEPA TSGSETPGTSESATPE SGPGTSTEPSEGSAP GTSTEPSEGSAPGTS TEPSEGSAPGTSTEPS EGSAPGTSTEPSEGS APGTSESATPESG PGSPAGSPTSTEEGSP AGSPTSTEEGTSTE PSEGSAPGTSESATP ESGPGSEPATSGSET PGTSESATPESGPGS EPATSGSETPGTSES ATPESGPGTSTEPSE GSAPGTSESATPESG PGSPAGSPTSTEEGSP AGSPTSTEEGSPAGS PTSTEEGTSESATPES GPGTSTEPSEGSAPG FPTIPLSRLFDNAML RAHRLHQLAFDTYQ EFEEAYIPKEQKYSF | 829 | ATGGCTGAACCTGCTGGCTCTCCAACCTCCACTGAGGAAGGTA CCCCGGGTAGCGGTACTGCTTCTTCCTCTCCAGGTAGCTCTACC CCTTCTGGTGCAACCGGCTCTCCAGGTGCTTCTCCGGGCACCAG CTACTCCGGTTCTCCAGGTAGCCCGGCTGGCTCTCCTACCTCTA CTGAGGAAGGTACTTCTGAAAGCGCTACTCCTGAGTCTGGTCCA GGTACCTCTACTGAACCGTCCGAAGGTAGCGCTCCAGGTAGCC CAGCAGGCTCTCCGACTTCCACTGAGGAAGGTACTTCTACTGAA CCTTCCGAAGGCAGCGCACCAGGTACCTCTACTGAACCTTCTGA GGGCAGCGCTCCAGGTACTTCTGAAAGCGCTACCCCGGAATCT GGCCCAGGTAGCGAACCGGCTACTTCTGGTTCTGAAACCCCAG GTAGCGAACCGGCTACCTCCGGTTCTGAAACTCCAGGTAGCCC AGGCAGGCTCTCCGACCTCTACTGAGGAAGGTACTTCTGAAAGC GCAACCCCGGAGTCCGGCCCAGGTACCTCTACCGAACCGTCTG AGGGCAGCGCACCAGGTACTTCTGAAAGCGCTGAGGGTAG CGCACCAGGTAGCCCAGCAGGTTCTCCTACCTCCACCGAGGAA GGTACTTCTACCGAACCGTCCGAGGGTAGCGCACCAGGTACCT CTACTGAACCTTCTGAGGGCAGCGCTCCAGGTACTTCTGAAAGC GCTACCCCGGAGTCCGGCCCAGGTACTTCTGAAAGCGCAACCC CTGAATCCGGCCCAGGTACCTCTGAAAGCGCAACCCCTGAATCC GGCCCAGGTAGCGAACCGGCTACTTCTGGCTCTGAGACTCCAG GTACTTCTACCGAACCGTCCGAAGGTAGCGCACCAGGTACTTCT ACTGAACCGTCTGAAGGTAGCGCACCAGGTACTTCTGAAAGCG CAACCCCGGAATCCGGCCCAGGTACCTCTGAAAGCGCAACCCC GGAGTCCGGCCCAGGTAGCCCTGCTGGCTCTCCAACCTCCACCG AAGAAGGTACCTCTGAAAGCGCAACCCCTGAATCCGGCCCAGG TAGCGAACCGGCAACCTCCGGTTCTGAAACCCCAGGTACCTCT GAAAGCGCTACTCCGGAGTCTGGCCCAGGTACCTCTACTGAAC CGTCTGAGGGTAGCGCTCCAGGTACTTCTACTGAACCGTCCGAA GGTAGCGCACCAGGTACTTCTACCGAACCGTCCGAAGGCAGCG CTCCAGGTACCTCTACTGAACCTTCCGAGGGCAGCGCTCCAGGT ACCTCTACCGAACCTTCTGAAGGTAGCGCACCAGGTACTTCTAC CGAACCGTCCGAGGGTAGCGCACCAGGTAGCCCAGCAGGTTCT CCTACCTCCACCGAGGAAGGTACTTCTACCGAACCGTCCGAGG GTAGCGCACCAGGTACCTCTGAAAGCGCAACTCCTGAGTCTGG CCCAGGTAGCGAACCTGCTACCTCCGGTTCTGAGACTCCAGGT ACCTCTGAAAGCGCAACCCCGGAATCTGGTCCAGGTAGCGAAC CTGCAACCTCTGGCTCTGAAACCCCAGGTACCTCTGAAAGCGCT ACTCCTGAATCTGGCCCAGGTACTTCTACTGAACCGTCCGAGGG CAGCGCTCCAGGTAGCCCGGCTGGCTCTCCGACTTCCACCGAGG AAGGTA GCCCGGCTGGCTCTCCAACTTCTACTGAAGAAGGTAGCCCGGC AGGCTCTCCGACCTCTACTGAGGAAGGTACTTCTGAAAGCGCA ACCCCGGAGTCCGGCCCAGGTACCTCTACCGAACCGTCTGAGG GCAGCGCACCAGGTTTTCCGACTATTCCGCTGTCTCGTCTGTTT | 830 |

TABLE 37-continued

Exemplary GHXTEN comprising growth hormones, XTEN and cleavage sequences

| GHXTEN Name* | Amino Acid Sequence | SEQ ID NO: | DNA Nucleotide Sequence | SEQ ID NO: |
|---|---|---|---|---|
| | LQNPQTSLCFSESIPT PSNREETQQKSNLEL LRISLLLIQSWLEPVQ FLRSVFANSLVYGAS DSNVYDLLKDLEEGI QTLMGRLEDGSPRT GQIFKQTYSKFDTNS HNDDALLKNYGLLY CFRKDMDKVETFLRI VQCRSVEGSCGFGL TPRSLLVGGGGSEPA TSGSETPGTSESATPE SGPGSEPATSGSETP GSPAGSPTSTEEGTS TEPSEGSAPGSEPAT SGSETPGSEPATSGS ETPGSEPATSGSETP GTSTEPSEGSAPGTS ESATPESGPGSEPAT SGSETPGTSTEPSEGS AP | | GATAATGCTATGCTGCGTGCGCACCGTCTGCACCAGCTGGCCTT TGATACTTACCAGGAATTTGAAGAAGCCTACATTCCTAAAGAGC AGAAGTACTCTTTCCTGCAAAACCCACAGACTTCTCTCTGCTTC AGCGAATCTATTCCGACGCCTTCCAATCGCGAGGAAACTCAGC AAAAGTCCAATCTGGAACTACTCCGCATTTCTCTGCTTCTGATT CAGAGCTGGCTAGAACCAGTGCAATTTCTGCGTTCCGTCTTCGC CAATAGCCTAGTTTATGGCGCATCCGACAGCAACGTATACGAT CTCCTGAAAGATCTCGAGGAAGGCATTCAGACCCTGATGGGTC GTCTCGAGGATGGCTCTCCGCGTACTGGTCAGATCTTCAAGCAG ACTTACTCTAAATTTGATACTAACAGCCACAATGACGATGCGCT TCTAAAAAACTATGGTCTGCTGTATTGTTTTCGTAAAGATATGG ACAAAGTTGAAACCTTCCTGCGTATTGTTCAGTGTCGTTCCGTT GAGGGCAGCTGTGGTTTCTAAGGTctgaccccgcgcagcctgctggtgggcggc GGTGGTAGCGAACCGGCTCAACTTCCGGCTCTGAAACCCCAGGTA CTTCTGAAAGCGCTACTCCTGAGTCTGGCCCAGGTAGCGAACCT GCTACCTCTGGCTCTGAAACCCCAGGTAGCCCGGCAGGCTCTCC GACTTCCACCGAGGAAGGTACCTCTACTGAACCTTCTGAGGGT AGCGCTCCAGGTAGCGAACCGGCAACCTCTGGCTCTGAAACCC CAGGTAGCGAACCTGCTACCTCCGGCTCTGAAACTCCAGGTAG CGAACCGGCTACTTCCGGTTCTGAAACTCCAGGTACCTCTACCG AACCTTCCGAAGGCAGCGCACCAGGTACTTCTGAAAGCGCAAC CCCTGAATCCGGTCCAGGTAGCGAACCGGCTACTTCTGGCTCTG AGACTCCAGGTACTTCTACCGAACCGTCCGAAGGTAGCGCACC A | |
| AE624-hGH-FXIa-AE144 | MAEPAGSPTSTEEGT PGSGTASSSPGSSTPS GATGSPGASPGTSST GSPGSPAGSPTSTEE GTSESATPESGPGTS TEPSEGSAPGSPAGS PTSTEEGTSTEPSEGS APGTSTEPSEGSAPG TSESATPESGPGSEP ATSGSETPGSEPATS GSETPGSPAGSPTST EEGTSESATPESGPG TSTEPSEGSAPGTSTE PSEGSAPGSPAGSPT STEEGTSTEPSEGSAP GTSTEPSEGSAPGTS ESATPESGPGTSTEPS EGSAPGTSESATPES GPGSEPATSGSETPG TSTEPSEGSAPGTSTE PSEGSAPGTSESATP ESGPGTSESATPESG PGSPAGSPTSTEEGT SESATPESGPEPA TSGSETPGTSESATPE SGPGTSTEPSEGSAP GTSTEPSEGSAPGTS TEPSEGSAPGTSTS TEPSEGSAPGTSTEPS EGSAPGTSTEPSEGS APGTSTEPSEGSAPG SPAGSPTSTEEGTSTE PSEGSAPGTSESATP ESGPGSEPATSGSET PGTSESATPESGPGS EPATSGSETPGTSES ATPESGPGTSTEPSE GSAPGTSESATPESG PGSPAGSPTSTEEGSP AGSPTSTEEGSPAGS PTSTEEGTSESATPES GPGTSTEPSEGSAPG FPTIPLSRLFDNAML RAHRLHQLAFDTYQ EFEEAYIPKEQKYSF LQNPQTSLCFSESIPT PSNREETQQKSNLEL LRISLLLIQSWLEPVQ FLRSVFANSLVYGAS DSNVYDLLKDLEEGI QTLMGRLEDGSPRT | 831 | ATGGCTGAACCTGCTGGCTCTCCAACCTCCACTGAGGAAGGTA CCCCGGGTAGCGGTACTGCTTCTTCCTCTCCAGGTAGCTCTACC CCTTCTGGTGCAACCGGCTCTCCAGGTGCTTCTCCGGGCACCAG CTCTACCGGTTCTCCAGGTAGCCCGGCTGGCTCTCCTACCTCTA CTGAGGAAGGTACTTCTGAAAGCGCTACTCCTGAGTCTGGTCCA GGTACCTCTACTGAACCGTCCGAAGGTAGCGCTCCAGGTAGCC CAGCAGGCTCTCCGACTTCCACCGAGGAAGGTACTTCTACTGAA CCTTCCGAAGGCAGCGCACCAGGTACCTCTACTGAACCGTCTGA GGGCAGCGCTCCAGGTACTTCTGAAAGCGCTACCCCGGAATCT GGCCCAGGTAGCGAACCGGCTACTTCTGGTTCTGAAACCCCAG GTAGCGAACCGGCTACCTCCGGTTCTGAAACTCCAGGTAGCCC GGCAGGCTCTCCGACTTCTACTGAAGGAAGGTACTTCTGAAAGC GCAACCCCGGAGTCCGGCCCAGGTACCTCTACCGAACCGTCTG AGGGCAGCGCACCAGGTACTTCTACCGAACCGTCCGAGGGTAG CGCACCAGGTAGCCCAGCAGGTTCTCCTACCTCCACCGAGGAA GGTACTTCTACCGAACCGTCCGAAGGTAGCGCACCAGGTACCT CTACTGAACCTTCTGAGGGCAGCGCTCCAGGTACTTCTGAAAGC GCTACCCCGGAGTCCGGTCCAGGTACTTCTACTGAACCGTCCGA AGGTAGCGCACCAGGTACTTCTGAAAGCGCAACCCCTGAATCC GGTCCAGGTAGCGAACCGGCTACTTCTGGCTCTGAGACTCCAG GTACTTCTACCGAACCGTCCGAAGGTAGCGCACCAGGTACTTCT ACTGAACCGTCTGAAGGTAGCGCACCAGGTACTTCTGAAAGCG CAACCCCGGAATCCGGCCCAGGTACCTCTGAAAGCGCAACCCC GGAGTCCGGCCCAGGTAGCCCTGCTGGCTCTCCAACCTCCACCG AAGAAGGTACCTCTGAAAGCGCAACCCCTGAATCCGGCCCAGG TAGCGAACCGGCAACCTCCGGTTCTGAAACCCCAGGTACCTCT GAAAGCGCTACTCCGGAGTCTGGCCCAGGTACCTCTACTGAAC CGTCTGAGGGTAGCGCACCAGGTACTTCTACTGAACCGTCCGAA GGTAGCGCACCAGGTACTTCTACCGAACCGTCCGAAGGCAGCG CTCCAGGTACCTCTACTGAACCTTCTGAGGGCAGCGCTCCAGGT ACCTCTACCGAACCGTCCGAGGGTAGCGCACCAGGTAGCCAGCAGGTTCT CCTACCTCCACCGAGGAAGGTTCTACCGAACCGTCCGAAGGT AGCGCACCAGGTACCTCTGAAAGCGCAACCCCTGAGTCTGG CCCAGGTAGCGAACCTGCTACCTCCGGCTCTGAGACTCCAGGT ACCTCTGAAAGCGCAACCCCGGAATCTGGTCCAGGTAGCGAAC CTGCAACCTCTGGCTCTGAAACCCCAGGTACCTCTGAAAGCGCT ACTCCTGAATCTGGCCCAGGTACTTCTACTGAACCGTCCGAGGG CAGCGCACCAGGTACTTCTGAAAGCGCTACTCCTGAGTCCGGC CCAGGTAGCCCGGCTGGCTCTCCGACTTCCACCGAGGAAGGTA GCCCGGCTGGCTCTCCAACCTCTACTGAAGAAGGTAGCCCGGC AGGCTCTCCGACCTCTACTGAGGAAGGTACTTCTGAAAGCGCA ACCCCGGAGTCCGGCCCAGGTACCTCTACCGAACCGTCTGAGG GCAGCGCACCAGGTTTTCCGACTATTCCGCTGTCTCGTCTGTTT GATAATGCTATGCTGCGTGCGCACCGTCTGCACCAGCTGGCCTT TGATACTTACCAGGAATTTGAAGAAGCCTACATTCCTAAAGAGC AGAAGTACTCTTTCCTGCAAAACCCACAGACTTCTCTCTGCTTC AGCGAATCTATTCCGACGCCTTCCAATCGCGAGGAAACTCAGC AAAAGTCCAATCTGGAACTACTCCGCATTTCTCTGCTTCTGATT CAGAGCTGGCTAGAACCAGTGCAATTTCTGCGTTCCGTCTTCGC | 832 |

TABLE 37-continued

Exemplary GHXTEN comprising growth hormones, XTEN and cleavage sequences

| GHXTEN Name* | Amino Acid Sequence | SEQ ID NO: | DNA Nucleotide Sequence | SEQ ID NO: |
|---|---|---|---|---|
| | GQIFKQTYSKFDTNS HNDDALLKNYGLLY CFRKDMDKVETFLRI VQCRSVEGSCGFGG GKLTRVVGGGGSEP ATSGSETPGTSESAT PESGPGSEPATSGSE TPGSPAGSPTSTEEG TSTEPSEGSAPGSEP ATSGSETPGSEPATS GSETPGSEPATSGSE TPGTSTEPSEGSAPG TSESATPESGPGSEP ATSGSETPGTSTEPSE GSAP | | CAATAGCCTAGTTTATGGCGCATCCGACAGCAACGTATACGAT CTCCTGAAAGATCTCGAGGAAGGCATTCAGACCCTGATGGGTC GTCTCGAGGATGGCTCTCCGCGTACTGGTCAGATCTTCAAGCAG ACTTACTCTAAATTTGATACTAACAGCCACAATGACGATGCGCT TCTAAAAAACTATGGTCTGCTGTATTGTTTTCGTAAAGATATGG ACAAAGTTGAAACCTTCCTGCGTATTGTTCAGTGTCGTTCCGTT GAGGGCAGCTGTGGTTTCTAAGGTggcggcaaactgacccgcgtggtgggcgg cggtggtagcgaaccggcaacttccggctctgaaaccccaggt ACTTCTGAAAGCGCTACTCCTGAGTCTGGCCCAGGTAGCGAAC CTGCTACCTCTGGCTCTGAAACCCCAGGTAGCCCGGCAGGCTCT CCGACTTCCACCGAGGAAGGTACCTCTACTGAACCTTCTGAGG GTAGCGCTCCAGGTAGCGAACCGGCAACCTCTGGCTCTGAAAC CCCAGGTAGCGAACCTGCTACCTCCGGCTCTGAAACTCCAGGT AGCGAACCGGCTACTTCCGGTTCTGAAACTCCAGGTACTTCTAC CGAACCTTCCGAAGGCAGCGCACCAGGTACTTCTGAAAGCGCA ACCCCTGAATCCGGTCCAGGTAGCGAACCGGCTACTTCTGGCTC TGAGATCCAGGTACTTCTACCGAACCGTCCGAAGGTAGCGCA CCA | |
| AE624-hGH-Elastase-AE144 | MAEPAGSPTSTEEGT PGSGTASSSPGSSTPS GATGSPGASPGTSST GSPGSPAGSPTSTEE GTSESATPESGPGTS TEPSEGSAPGSPAGS PTSTEEGTSTEPSEGS APGTSTEPSEGSAPG TSESATPESGPGSEP ATSGSETPGSEPATS GSETPGSPAGSPTST EEGTSESATPESGPG TSTEPSEGSAPGTSTE PSEGSAPGSPAGSPT STEEGTSTEPSEGSAP GTSTEPSEGSAPGTS ESATPESGPGTSTEPS EGSAPGTSESATPES GPGSEPATSGSETPG TSTEPSEGSAPGTSTE PSEGSAPGTSESATP ESGPGTSESATPESG PGSPAGSPTSTEEGT SESATPESGPGSEPA TSGSETPGTSESATPE SGPGTSTEPSEGSAP GTSTEPSEGSAPGTS TEPSEGSAPGTSTEPS EGSAPGTSTEPSEGS APGTSTEPSEGSAPG SPAGSPTSTEEGTSTE PSEGSAPGTSESATP ESGPGSEPATSGSET PGTSESATPESGPGS EPATSGSETPGTSES ATPESGPGTSTEPSE GSAPGTSESATPESG PGSPAGSPTSTEEGSP AGSPTSTEEGSPAGS PTSTEEGTSESATPES GPGTSTEPSEGSAPG FPTIPLSRLFDNAML RAHRLHQLAFDTYQ EFEEAYIPKEQKYSF LQNPQTSLCFSESIPT PSNREETQQKSNLEL LRISLLLIQSWLEPVQ FLRSVFANSLVYGAS DSNVYDLLKDLEEGI QTLMGRLEDGSPRT GQIFKQTYSKFDTNS HNDDALLKNYGLLY CFRKDMDKVETFLRI VQCRSVEGSCGFGG GLGPVSGVPGGSEPA TSGSETPGTSESATPE | 833 | ATGGCTGAACCTGCTGGCTCTCCAACCTCCACTGAGGAAGGTA CCCCGGGTAGCGGTACTGCTTCTTCCTCTCCAGGTAGCTCTACC CCTTCTGGTGCAACCGGCTCTCCAGGTGCTTCTCCGGGCACCAG CTCTACCGGTTCTCCAGGTAGCCCGGCTGGCTCTCCTACCTCTA CTGAGGAAGGTACTTCTGAAAGCGCTACTCCTGAGTCTGGTCCA GGTACCTCTACTGAACCGTCCGAAGGTAGCGCTCCAGGTAGCC CAGCAGGCTCTCCGACTTCCACTGAGGAAGGTACTTCTACTGAA CCTTCCGAAGGCAGCGCACCAGGTACCTCTACTGAACCTTCTGA GGGCAGCGCTCCAGGTACTTCTGAAAGCGCTACCCCGGAATCT GGCCCAGGTAGCGAACCGGCTACTTCTGGTTCTGAAACCCAG GTAGCGAACCGGCTACCTCCGGTTCTGAAACTCAGGTAGCCC GGCAGGCTCTCCGACCTCTACTGAGGAAGGTACTTCTGAAAGC GCAACCCCGGAGTCCGGCCCAGGTACCTCTACCGAACCGTCTG AGGGCAGCGCACCAGGTACTTCTACCGAACCGTCGAGGGTAG CGCACCAGGTAGCCCAGCAGGTTCTCCTACCTCCACCGAGGAA GGTACTTCTACCGAACCGTCCGAGGGTAGCGCACCAGGTACCT CTACTGAACCTTCTGAGGGCAGCGCTCCAGGTACTTCTGAAAGC GCTACCCCGGAGTCCGGTCCAGGTACTTCTACTGAACCGTCCGA AGGTAGCGCACCAGGTACTTCTGAAAGCGCAACCCCTGAATCC GGTCCAGGTAGCGAACCGGCTACTTCTGGCTCTGAGACTCCAG GTACTTCTACCGAACCGTCCGAAGGTAGCGCACCAGGTACTTCT ACTGAACCGTCTGAAGGCAGCGCACCAGGTACTTCTGAAAGCG CAACCCCGGAATCCGGCCCAGGTACCTCTGAAAGCGCAACCCC GGAGTCCGGCCCAGGTAGCCCTGCTGGCTCTCCAACCTCCACCG AAGAAGGTACCTCTGAAAGCGCAACCCCTGAATCCGGCCCAGG TAGCGAACCGGCAACCTCCGGTTCTGAAACCCAGGTACCTCT GAAAGCGCTACTCCGGAGTCTGGCCCAGGTACCTCTACTGAAC CGTCTGAGGGTAGCGCTCCAGGTACTTCTACTGAACCGTCCGAA GGTAGCGCACCAGGTACTTCTACCGAACCGTCCGAAGGCAGCG CTCCAGGTACCTCTACTGAACCTTCCGAGGGCAGCGCTCCAGGT AGCCCGGCAGGTACCTCTACCGAACCTTCTGAAGGTAGCGCACCAGGTACTTCTAC CGAACCGTCCGAGGGTAGCGCACCAGGTAGCCCAGCAGGTTCT CCTACCTCCACCGAGGAAGGTACTTCTACCGAACCGTCCGAGG GTAGCGCACCAGGTACTTCTGAAAGCGCAACCTCCTGAGTCTGG CCCAGGTAGCGAACCTGCTACCTCCGGCTCTGAGACTCCAGGT ACCTCTGAAAGCGCAACCCCGGAATCTGGTCCAGGTAGCGAAC CTGCAACCTCTGGCTCTGAAACCCCAGGTACCTCTGAAAGCGCT ACTCCTGAATCGGCCCAGGTACTTCTACTGAACGTCCGAGGG CAGCGCACCAGGTACTTCTACCGAGTCCGGTC CCAGGTAGCCCGGCTGGCTCTCCGACTTCCACCGAGGAAGGTA GCCCGGCTGGCTCTCCAACTTCTACTGAAGAAGGTAGCCCGGC AGGCTCTCCGACCTCTACTGAGGAAGGTACTTCTGAAAGCGCA ACCCCGGAGTCCGGCCCAGGTACTTCTACCGAACCGTCTGAGG GCAGCGCACCAGGTTTTCCGACTATTCCGCTGTCTCGTCTGTTT GATAATGCTATGCTGCGTGCGCACCGTCTGCACCAGCTGGCCTT TGATACTTACCAGGAATTTGAAGAAGCcTACATTCCTAAAGAGC AGAAGTACTCTTTCTGCAAAACCCACAGACTTCTCTGCTTC AGCGAATCTATTCCGACGCCTTCCAATCGCGAGGAAACTCAGC AAAAGTCCAATCTGGAACTACTCCGCATTTCTCTGCTTCTGATT CAGAGCTGGCTAGAACCAGTGCAATTTCTGCGTTCCGTCTTCGC CAATAGCCTAGTTTATGGCGCATCCGACAGCAACGTATACGAT CTCCTGAAAGATCTCGAGGAAGGCATTCAGACCCTGATGGGTC GTCTCGAGGATGGCTCTCCGCGTACTGGTCAGATCTTCAAGCAG ACTTACTCTAAATTTGATACTAACAGCCACAATGACGATGCGCT TCTAAAAAACTATGGTCTGCTGTATTGTTTTCGTAAAGATATGG ACAAAGTTGAAACCTTCCTGCGTATTGTTCAGTGTCGTTCCGTT | 834 |

TABLE 37-continued

Exemplary GHXTEN comprising growth hormones, XTEN and cleavage sequences

| GHXTEN Name* | Amino Acid Sequence | SEQ ID NO: | DNA Nucleotide Sequence | SEQ ID NO: |
|---|---|---|---|---|
| | SGPGSEPATSGSETP GSPAGSPTSTEEGTS TEPSEGSAPGSEPAT SGSETPGSEPATSGS ETPGSEPATSGSETP GTSTEPSEGSAPGTS ESATPESGPGSEPAT SGSETPGTSTEPSEGS AP | | GAGGGCAGCTGTGGTTTCTAAGGTggcggcctgggcccggtgagcggcgtgcc gGGTGGTAGCGAACCGGCAACTTCCGGCTCTGAAACCCCAGGT ACTTCTGAAAGCGCTACTCCTGAGTCTGGCCCAGGTAGCGAAC CTGCTACCTCTGGCTCTGAAACCCCAGGTAGCCCGGCAGGCTCT CCGACTTCCACCGAGGAAGGTACCTCTACTGAACCTTCTGAGG GTAGCGCTCCAGGTAGCGAACCGGCAACCTCTGGCTCTGAAAC CCCAGGTAGCGAACCTGCTACCTCCGGCTCTGAAACTCCAGGT AGCGAACCGGCTACTTCCGGTTCTGAAACTCCAGGTACCTCTAC CGAACCTTCCGAAGGCAGCGCACCAGGTACTTCTGAAAGCGCA ACCCCTGAATCCGGTCCAGGTAGCGAACCGGCTACTTCTGGCTC TGAGACTCCAGGTACTTCTACCGAACCGTCCGAAGGTAGCGCA CCA | |
| AE624-hGH-MMP-17-AE144 | MAEPAGSPTSTEEGT PGSGTASSSPGSSTPS GATGSPGASPGTSST GSPGSPAGSPTSTEE GTSESATPESGPGTS TEPSEGSAPGSPAGS PTSTEEGTSTEPSEGS APGTSTEPSEGSAPG TSESATPESGPGSEP ATSGSETPGSEPATS GSETPGSPAGSPTST EEGTSESATPESGPG TSTEPSEGSAPGTSTE PSEGSAPGSPAGSPT STEEGTSTEPSEGSAP GTSTEPSEGSAPGTS ESATPESGPGTSTEPS EGSAPGTSESATPES GPGSEPATSGSETPG TSTEPSEGSAPGTSTE PSEGSAPGTSESATP ESGPGTSESATPESG PGSPAGSPTSTEEGT SESATPESGPGSEPA TSGSETPGTSESATPE SGPGTSTEPSEGSAP GTSTEPSEGSAPGTS TEPSEGSAPGTSTEPS EGSAPGTSTEPSEGS APGTSTEPSEGSAPG SPAGSPTSTEEGTSTE PSEGSAPGTSESATP ESGPGSEPATSGSET PGTSESATPESGPGS EPATSGSETPGTSES ATPESGPGTSTEPSE GSAPGTSESATPESG PGSPAGSPTSTEEGSP AGSPTSTEEGSPAGS PTSTEEGTSESATPES GPGTSTEPSEGSAPG FPTIPLSRLFDNAML RAHRLHQLAFDTYQ EFEEAYIPKEQKYSF LQNPQTSLCFSESIPT PSNREETQQKSNLEL LRISLLLIQSWLEPVQ FLRSVFANSLVYGAS DSNVYDLLKDLEEGI QTLMGRLEDGSPRT GQIFKQTYSKFDTNS HNDDALLKNYGLLY CFRKDMDKVETFLRI VQCRSVEGSCGFGA PLGLRLRGGGGSEPA TSGSETPGTSESATPE SGPGSEPATSGSETP GSPAGSPTSTEEGTS TEPSEGSAPGSEPAT SGSETPGSEPATSGS ETPGSEPATSGSETP GTSTEPSEGSAPGTS | 835 | ATGGCTGAACCTGCTGGCTCTCCAACCTCCACTGAGGAAGGTA CCCCGGGTAGCGGTACTGCTTCTTCCTCTCCAGGTAGCTCTACC CCTTCTGGTGCTACCGGCTCTCCAGGTGCTTCTCCGGGCACCAG CTCTACCGGTTCTCCAGGTAGCCCGGCTGGCTCTCCTACCTCTA CTGAGGAAGGTACTTCTGAAAGCGCTACTCCTGAGTCTGGTCCA GGTACCTCTACTGAACCGTCCGAAGGTAGCGCTCCAGGTAGCC CAGCAGGCTCTCCGACTTCCACTGAGGAAGGTACTTCTGAAGA CCTTCCGAAGGCAGCGCACCAGGTACCTCTACTGAACCTTCTGA GGGCAGCGCTCCAGGTACTTCTGAAAGCGCTACCCCGGAATCT GGCCCAGGTAGCGAACCGGCTACTTCTGGTTCTGAAACCCCAG GTAGCGAACCGGCTACCTCCGGTTCTGAAACTCCAGGTGCCC GGCAGGCTCTCCGACCTCTACTGAGGAAGGTACTTCTGAAAGC GCAACCCCGGAGTCCGGCCCAGGTACCTCTACCGAACCGTCTG AGGGCAGCGCACCAGGTACTTCTACCGAACCGTCCGAGGGTAG CGCACCAGGTAGCCCAGCAGGTTCTCCTACCTCCACCGAGGAA GGTACTTCTACCGAACCGTCCGAGGGTAGCGCACCAGGTACCT CTACTGAACCTTCTGAGGGCAGCGCTCCAGGTACTTCTGAAAGC GCTACCCCGGAGTCCGGTCCAGGTACTTCTACTGAACCGTCCGA AGGTAGCGCACCAGGTACTTCTGAAAGCGCAACCCCTGAATCC GGTCCAGGTAGCGAACCGGCTACTTCTGGCTCTGAGACTCCAG GTACTTCTACCGAACCGTCCGAAGGTAGCGCACCAGGTACTTCT ACTGAACCGTCTGAAGGTAGCGCACCAGGTACTTCTGAAAGCG CAACCCCGGAATCCGGCCCAGGTACCTCTGAAAGCGCAACCCC GGAGTCCGGCCCAGGTGCTTCTCCAACCTCCACCG AAGAAGGTACCTCTGAAAGCGCAACCCCTGAATCCGGCCCAGG TAGCGAACCGGCAACCTCCGGTTCTGAAACCCCAGGTACCTCT GAAAGCGCTACTCCGGAGTCTGGCCCAGGTACCTCTACTGAAC CGTCTGAGGGTAGCGCTCCAGGTACTTCTACTGAACCGTCCGAA GGTAGCGCACCAGGTACTTCTACCGAACCGTCCGAAGGCAGCG CTCCAGGTACCTCTACTGAACCTTCCGAGGGCAGCGCTCCAGGT AGCCCAGCTGGCTCTCCAACTTCTACTGAAGAAGGTAGCCCGGC AGGCTCTCCGACCTCTACTGAGGAAGGTACTTCTGAAAGCGCA ACCCCGGAGTCCGGCCCAGGTACCTCTACCGAACCGTCTGAGG GCAGCGCACCAGGTTTCCGACTATTCCGCTGTCTCGTCTGTTT GATAATGCTATGCTGCGTGCGCACCGTCTGCACCAGCTGGCT TGATACTTACCAGGAATTTGAAGAAGCcTACATTCCTAAAGAGC AAAAGTACTCTTTCCTGCAAAACCCACAGACTTCTCTCTGCTTC AGCGAATCTATTCCGACGCCTTCCAATCGCGAGGAAACTCAGC AAAAGTCCAATCTGGAACTACTCCGCATTTCTCTGCTTCTGATT CAGAGCTGGCTAGAACAGTGCAATTTCTGCGTTCCGTCTTCGC CAATAGCCTAGTTTATGGCGCATCCGACAGCAACGTATACGAT CTCCTGAAAGATCTCGAGGAAGGCATTCAGACCCTGATGGGTC GTCTCGAGGATGGCTCTCCGCGTACTGGTCAGATCTTCAAGCAG ACTTACTCTAAATTTGATACTAACAGCCACAATGACGATGCGCT TCTAAAAAACTATGGTCTGCTGTATTGTTTTCGTAAAGATATGG ACAAAGTTGAAACCTTCCTGCGTATTGTTCAGTGTCGTTCCGTT GAGGGCAGCTGTGGTTTCTAAGGTgcgcgctgggcctgcgccgtgcgcggcgg cGGTGGTAGCGAACCGGCAACTTCCGGCTCTGAAACCCCAGGT ACTTCTGAAAGCGCTACTCCTGAGTCTGGCCCAGGTAGCGAAC CTGCTACCTCTGGCTCTGAAACCCCAGGTAGCCCGGCAGGCTCT CCGACTTCCACCGAGGAAGGTACCTCTACTGAACCTTCTGAGG GTAGCGCTCCAGGTAGCGAACCGGCAACCTCTGGCTCTGAAAC | 836 |

TABLE 37-continued

Exemplary GHXTEN comprising growth hormones, XTEN and cleavage sequences

| GHXTEN Name* | Amino Acid Sequence | SEQ ID NO: | DNA Nucleotide Sequence | SEQ ID NO: |
|---|---|---|---|---|
| | ESATPESGPGSEPAT SGSETPGTSTEPSEGS AP | | CCCAGGTAGCGAACCTGCTACCTCCGGCTCTGAAACTCCAGGT AGCGAACCGGCTACTTCCGGTTCTGAAACTCCAGGTACCTCTAC CGAACCTTCCGAAGGCAGCGCACCAGGTACTTCTGAAAGCGCA ACCCCTGAATCCGGTCCAGGTAGCGAACCGGCTACTTCTGGCTC TGAGACTCCAGGTACTTCTACCGAACCGTCCGAAGGTAGCGCA CCA | |
| AE624-hGH-Thrombin-AE288 | MAEPAGSPTSTEEGT PGSGTASSSPGSSTPS GATGSPGASPGTSST GSPGSPAGSPTSTEE GTSESATPESGPGTS TEPSEGSAPGSPAGS PTSTEEGTSTEPSEGS APGTSTEPSEGSAPG TSESATPESGPGSEP ATSGSETPGSEPATS GSETPGSPAGSPTST EEGTSESATPESGPG TSTEPSEGSAPGTSTE PSEGSAPGSPAGSPT STEEGTSTEPSEGSAP GTSTEPSEGSAPGTS ESATPESGPGTSTEPS EGSAPGTSESATPES GPGSEPATSGSETPG TSTEPSEGSAPGTSTE PSEGSAPGTSESATP ESGPGTSESATPESG PGSPAGSPTSTEEGT SESATPESGPGSEPA TSGSETPGTSESATPE SGPGTSTEPSEGSAP GTSTEPSEGSAPGTS TEPSEGSAPGTSTEPS EGSAPGTSTEPSEGS APGTSTEPSEGSAPG SPAGSPTSTEEGTSTE PSEGSAPGTSESATP ESGPGSEPATSGSET PGTSESATPESGPGS EPATSGSETPGTSES ATPESGPGTSTEPSE GSAPGTSESATPESG PGSPAGSPTSTEEGSP AGSPTSTEEGSPAGS PTSTEEGTSESATPES GPGTSTEPSEGSAPG FPTIPLSRLFDNAML RAHRLHQLAFDTYQ EFEEAYIPKEQKYSF LQNPQTSLCFSESIPT PSNREETQQKSNLEL LRISLLLIQSWLEPVQ FLRSVFANSLVYGAS DSNVYDLLKDLEEGI QTLMGRLEDGSPRT GQIFKQTYSKFDTNS HNDDALLKNYGLLY CFRKDMDKVETFLRI VQCRSVEGSCGFGL TPRSLLVGGGGTSES ATPESGPGSEPATSG SETPGTSESATPESGP GSEPATSGSETPGTS ESATPESGPGTSTEPS EGSAPGSPAGSPTST EEGTSESATPESGPG SEPATSGSETPGTSES ATPESGPGAGSPT STEEGSPAGSPTSTEE GTSTEPSEGSAPGTS ESATPESGPGTSESA TPESGPGTSESATPES GPGSEPATSGSETPG | 837 | ATGGCTGAACCTGCTGGCTCTCCAACCTCCACTGAGGAAGGTA CCCCGGGTAGCGGTACTGCTTCTTCCCTCCAGGTAGCTCTACC CCTTCTGGTGCAACCGGCTCTCCAGGTGCTTCTCCGGGCACCAG CTCTACCGGTTCTCCAGGTAGCCCGGCTGGCTCTCCTACCTCTA CTGAGGAAGGTACTTCTGAAAGCGCTACTCCTGAGTCTGGTCCA GGTACCTCTACTGAACCGTCCGAAGGTAGCGCTCCAGGTAGCC CAGCAGGCTCTCCGACTTCCACTGAGGAAGGTACTTCTACTGAA CCTTCCGAAGGCAGCGCACCAGGTACCTCTACTGAACCTTCTGA GGGCAGCGCTCCAGGTACTTCTGAAAGCGCTACCCCGGAATCT GGCCCAGGTAGCGAACCGGCTACTTCTGGTTCTGAAACCCCAG GTAGCGAACCGGCTACCTCCGGTTCTGAAACTCCAGGTAGCCC GGCAGGCTCTCCGACCTCTACTGAGGAAGGTACTTCTGAAAGC GCAACCCCGGAGTCCGGCCCAGGTACCTCTACCGAACCGTCTG AGGGCAGCGCACCAGGTACTTCTACCGAACCGTCCGAGGGTAG CGCACCAGGTAGCCCAGCAGGTTCTCCTACCTCCACCGAGGAA GGTACTTCTACCGAACCGTCCGAGGGTAGCGCACCAGGTACCT CTACTGAACCTTCTGAGGGCAGCGCTCCAGGTACTTCTGAAAGC GCTACCCCGGAGTCCGGTCCAGGTACTTCTACTGAACCGTCCGA AGGTAGCGCACCAGGTACTTCTGAAAGCGCAACCCCTGAATCC GGTCCAGGTAGCGAACCGGCTACTTCTGGCTCTGAGACTCCAG GTACTTCTACCGAACCGTCTGAAGGTAGCGCACCAGGTACTTCT ACTGAACCGTCTGAAGGTAGCGCACCAGGTACTTCTGAAAGCG PGSPAGSPTSTEEGT CAACCCCGGAATCCGGCCCAGGTACCTCTGAAAGCGCAACCCC GGAGTCCGGCCCAGGTAGCCCTGCTGGCTCTCCAACCTCCACCG AAGAAGGTACCTCTGAAAGCGCAACCCCTGAATCCGGCCCAGG TAGCGAACCGGCAACCTCCGGTTCTGAAACCCCAGGTACCTCT GAAAGCGCTACTCCGGAGTCTGGCCCAGGTACCTCTACTGAAC CGTCTGAGGGTAGCGCTCCAGGTACTTCTACTGAACCGTCCGAA GGTAGCGCACCAGGTACTTCTACCGAACCGTCCGAAGGCAGCG CTCCAGGTACCTCTACTGAACCTTCCGAGGGCAGCGCTCCAGGT ACCTCTACCGAACCTTCTGAAGGTAGCGCACCAGGTACTTCTAC CGAACCGTCCGAGGGTAGCGCACCAGGTAGCCCAGCAGGTTCT CCTACCTCCACCGAGGAAGGTACTTCTACCGAACCGTCCGAGG GTAGCGCACCAGGTACCTCTGAAAGCGCAACTCCTGAGTCTGG CCCAGGTAGCGAACCTGCTACCTCCGGCTCTGAGACTCCAGGT ACCTCTGAAAGCGCAACCCCGGAATCTGGTCCAGGTAGCGAAC CTGCAACCTCTGGCTCTGAAACCCCAGGTACCTCTGAAAGCGCT ACTCCTGAATCCGGTCCAGGTAGCGAACCGGCAACTTCTGGCT CAGCGCACCAGGTACTTCTGAAAGCGCTACTCCTGAGTCCGGC CCAGGTAGCCCGGCTGGCTCTCCGACTTCCACCGAGGAAGGTA GCCCGGCTGGCTCTCCAACTTCTACTGAAGAAGGTAGCCCGGC AGGTTCTCCGACCTCTACTGAAGAAGGTACTTCTGAAAGCGCTA ACCCCGGAGTCCGGCCCAGGTACCTCTACCGAACCGTCTGAGG GCAGCGCACCAGGTTTTCCGACTATTCCGCTGTCTCGTCTGTTT GATAATGCTATGCTGCGTGCGCACCGTCTGCACCAGCTGGCTTT TGATACTTACCAGGAATTTGAAGAGCcTACATTCCTAAAGAGC AGAAGTACTCTTTCCTGCAAACCCACAGACTTCTCTCTGCTTC AGCGAATCTATTCCGACGCCTTCCAATCGCGAGGAAACTCAGC AAAAGTCCAATCTGGAACTACTCCGCATTTCTCTGCTTCTGATT CAGAGCTGGCTAGAACCAGTGCAATTTCTGCGTTCCGTCTTCGC CAATAGCCTAGTTTATGCGCATCCGACAGCAACGTATACGAT CTCCTGAAAGATCTCGAGGAAGGCATTCAGACCCTGATGGGTC GTCTCGAGGATGGCTCTCCGCGTACTGGTCAGATCTTCAAGCAG ACTTACTCTAAATTTGATACTAACAGCCACAATGACGATGCGCT TCTAAAAAACTATGGTCTGCTGTATTGTTTTCGTAAAGATATGG ACAAAGTTGAAACCTTCCTGCGTATTGTTCAGTGTCGTTCCGTT GAGGGCAGCTGTGGTTTTAAGGTctgacccgcgcagcctgctggtgggcggc GGTGGTACCTCTGAAAGCGCAACTCCTGAGTCTGGCCCAGGTA GCGAACCTGCTACCTCCGGTGAGACTCCAGGTACCTCTGAA AGCGCAACCCCGGAATCTGGTCCAGGTAGCGAACCTGCAACCT CTGGCTCTGAAACCCCAGGTACCTCTGAAAGCGCTACTCCTGAA TCTGGCCCAGGTACTTCTACTGAACCGTCCGAGGGCAGCGCAC CAGGTGCTCCTCTCCAACCTCCACCGAGGAAGGTAC CTCTGAAAGCGCAACCCCTGAATCCGGCCCAGGTAGCGAACCG GCAACCTCCGGTTCTGAAACCCCAGGTACTTCTGAAAGCGCTAC TCCTGAGTCCGGCCCAGGTAGCCCGGCTGGCTCTCCGACTTCCA CCGAGGAAGGTAGCCCGGCTGGCTCTCCAACTTCTACTGAAGA AGGTACTTCTACCGAACCTTCCGAGGGCAGCGCACCAGGTACT | 838 |

TABLE 37-continued

Exemplary GHXTEN comprising growth hormones, XTEN and cleavage sequences

| GHXTEN Name* | Amino Acid Sequence | SEQ ID NO: | DNA Nucleotide Sequence | SEQ ID NO: |
|---|---|---|---|---|
| | SEPATSGSETPGSPA GSPTSTEEGTSTEPSE GSAPGTSTEPSEGSA PGSEPATSGSETPGT SESATPESGPGTSTEP SEGSAP | | TCTGAAAGCGCTACCCCTGAGTCCGGCCCAGGTACTTCTGAAA GCGCTACTCCTGAATCCGGTCCAGGTACTTCTGAAAGCGCTACC CCGGAATCTGGCCCAGGTAGCGAACCGGCTACCTCCGGTTCTGA AACCCCAGGTAGCGAACCGGCTACCTCCGGTTCTGAAACTCCA GGTAGCCCAGCAGGCTCTCCGACTTCCACTGAGGAAGGTACTT CTACTGAACCTTCCGAAGGCAGCGCACCAGGTACCTCTACTGA ACCTTCTGAGGGCAGCGCTCCAGGTAGCGAACCTGCAACCTCT GGCTCTGAAACCCCAGGTACCTCTGAAAGCGCTACTCCTGAATC TGGCCCAGGTACTTCTACTGAACCGTCCGAGGGCAGCGCACCA | |
| AE624-hGH-FXIa-AE288 | MAEPAGSPTSTEEGT PGSGTASSSPGSSTPS GATGSPGASPGTSST GSPGSPAGSPTSTEE GTSESATPESGPGTS TEPSEGSAPGSPAGS PTSTEEGTSTEPSEGS APGTSTEPSEGSAPG TSESATPESGPGSEP ATSGSETPGSEPATS GSETPGSPAGSPTST EEGTSESATPESGPG TSTEPSEGSAPGTSTE PSEGSAPGSPAGSPT STEEGTSTEPSEGSAP GTSTEPSEGSAPGTS ESATPESGPGTSTEPS EGSAPGTSESATPES GPGSEPATSGSETPG TSTEPSEGSAPGTSTE PSEGSAPGTSESATP ESGPGTSESATPESG PGSPAGSPTSTEEGT SESATPESGPGSEPA TSGSETPGTSESATPE SGPGTSTEPSEGSAP GTSTEPSEGSAPGTS TEPSEGSAPGTSTEPS EGSAPGTSTEPSEGS APGTSTEPSEGSAPG SPAGSPTSTEEGTSTE PSEGSAPGTSESATP ESGPGSEPATSGSET PGTSESATPESGPGS EPATSGSETPGTSES ATPESGPGTSTEPSE GSAPGTSESATPESG PGSPAGSPTSTEEGSP AGSPTSTEEGTSESA PESGPGTSTEPSEGSAPG FPTIPLSRLFDNAML RAHRLHQLAFDTYQ EFEEAYIPKEQKYSF LQNPQTSLCFSESIPT PSNREETQQKSNLEL LRISLLLIQSWLEPVQ FLRSVFANSLVYGAS DSNVYDLLKDLEEGI QTLMGRLEDGSPRT GQIFKQTYSKFDTNS HNDDALLKNYGLLY CFRKDMDKVETFLRI VQCRSVEGSCGFGG GKLTRVVGGGTSE SATPESGPGSEPATS GSETPGTSESATPES GPGSEPATSGSETPG TSESATPESGPGTSTE PSEGSAPGSPAGSPT STEEGTSESATPESGP GSEPATSGSETPGTS ESATPESGPGSPAGS PTSTEEGSPAGSPTST EEGTSTEPSEGSAPG | 839 | ATGGCTGAACCTGCTGGCTCTCCAACCTCCACTGAGGAAGGTA CCCCGGGTACGGCTACGTCTTCCTCTCCAGGTAGCTCTACC CCTTCTGGTGCAACCGGCTCTCCAGGTGCTTCTCCGGGCACCAG CTCTACCGGTTCTCCAGGTAGCCCGGCTGGCTCTCCTACCTCTA CTGAGGAAGGTACTTCTGAAAGCGCTACTCCTGAGTCTGGTCCA GGTACCTCTACTGAACCGTCCGAAGGTAGCGCTCCAGGTAGCC CAGCAGGCTCTCCGACTTCCACTGAGGAAGGTACTTCTACTGAA CCTTCCGAAGGCAGCGCACCAGGTACCTCTACTGAACCTTCTGA GGGCAGCGCTCCAGGTACTTCTGAAAGCGCTACCCCGGAATCT GGCCCAGGTAGCGAACCGGCTACCTCTTGGTTCTGAAACCCCAG GTAGCGAACCGGCTACCTCCGGTTCTGAAACTCCAGGTAGCCCA GGCAGGCTCTCCGACCTCTACTGAGGAAGGTACTTCTGAAAGC GCAACCCCGGAGTCCGGCCCAGGTACCTCTACCGAACCGTCTG AGGGCAGCGCACCAGGTACTTCTACCGAACCGTCCGAGGGTAG CGCACCAGGTAGCCCAGCAGGTTCTCCTACCTCCACCGAGGAA GGTACTTCTACCGAACCGTCCGAGGGTAGCGCACCAGGTACCT CTACTGAACCTTCTGAGGGCAGCGCTCCAGGTACTTCTGAAAGC GCTACCCCGGAGTCCGGTCCAGGTACTTCTACTGAACCGTCGA AGGTAGCGCACCAGGTACTTCTGAAAGCGCAACCCCTGAATCC GGTCCAGGTAGCGAACCGGCTACTTCTGGCTCTGAGACTCCAG GTACTTCTACCGAACCGTCCGAAGGTAGCGCACCAGGTACTTCT ACTGAACCGTCTGAAGGTAGCGCACCAGGTACTTCTGAAAGCG CAACCCCGGAATCCGGCCCAGGTACCTCTGAAAGCGCAACCCC GGAGTCCGGCCCAGGTAGCCCTGCTGGCTCTCCAACCTCCACCG AAGAAGGTACCTCTGAAAGCGCAACCCCTGAATCCGGCCCAGG TAGCGAACCGGCAACCTCCGGTTCTGAAACCCCAGGTACCTCT GAAAGCGCTACTCCGGAGTCTGGCCCAGGTACCTCTACTGAAC CGTCTGAGGGTAGCGCTCCAGGTACTTCTACTGAACCGTCCGAA GGTAGCGCACCAGGTACTTCTACCGAACCGTCCGAAGGCAGCG CTCCAGGTACCTCTACTGAACCTTCCGAGGGCAGCGCTCCAGGT ACCTCTACCGAACCTTCTGAAGGTAGCGCACCAGGTACTTCTAC CGAACCGTCCGAGGGTAGCGCACCAGGTAGCCCAGCAGGTTCT CCTACCTCCACCGAGGAAGGTACTTCTACCGAACCGTCCGAGG GTAGCGCACCAGGTACCTCTGAAAGCGCAACTCCTGAGTCTGG CCCAGGTAGCGAACCTGCTACCTCCGGCTCTGAGACTCCAGGT ACCTCTGAAAGCGCAACCCCGGAATCTGGTCCAGGTAGCGAAC CTGCAACCTCTGGCTCTGAAACCCCAGGTACCTCTGAAAGCGCT ACTCCTGAATCTGGCCCAGGTACTTCTACTGAACCGTCCGAGGG CAGCGCACCAGGTACTTCTGAAAGCGCTACTCCTGAGTCCGGC CCAGGTAGCCCGGCTGGCTCTCCGACTTCCACCGAGGAAGGTA GCCCGGCTGGCTCTCCAACTTCTACTGAAGAAGGTAGCCCCGGC AGGCTCTCCGACCTCTACTGAGGAAGGTACTTCTGAAAGCGCA ACCCCGGAGTCCGGCCCAGGTACCTCTACCGAACCGTCTGAGG GCAGCGCACCAGGTTTTCCGACTATTCCGCTGTCTCGTCTGTTT GATAATGCTATGCTGCGTGCGCACCGTCTGCACCAGCTGGCCTT TGATACTTACCAGGAATTTGAAGAAGCtACATTCCTAAAGAGC AGAAGTACTCTTTCCTGCAAAACCCACAGACTTCTCTCTGCTTC AGCGAATCTATTCCGACGCCTTCCAATCGCGAGGAAACTCAGC AAAAGTCCAATCTGGAACTACTCCGCATTTCTCTGCTTCTGATT CAGAGCTGGCTAGAACCAGTGCAATTTCTGCGTTCCGTCTTCGC CAATAGCCTAGTTTATGGCGCATCCGACAGCAACGTATACGAT CTCCTGAAAGATCTCGAGGAAGGCATTCAGACCCTGATGGGTC GTCTCGAGGATGGCTCTCCGCGTACTGGTCAGATCTTCAAGCAG ACTTACTCTAAATTTGATACTAACAGCCACAATGACGATGCGCT TCTAAAAAACTATGGTCTGCTGTATTGTTTTCGTAAAGATATGG ACAAAGTTGAAACTTTCCTGCGTATTGTTCAGTGTCGTTCCGTT GAGGGCAGCTGTGGTTTTAAGGTggcggcaaactgacccgcgtggtgggcgg cGGTGGTACCTCTGAAAGCGCAACTCCTGAGTCTGGCCCAGGTA GCGAACCTGCTACCTCCGGCTCTGAGACTCCAGGTACCTCTGAA AGCGCTACTCCGGCTCTGGTAGCGAACCTGCAACCT CTGGCTCTGAAACCCCAGGTACCTCTGAAAGCGCTACTCCTGAA TCTGGCCCAGGTACTTCTACTGAACCGTCCGAGGGCAGCGCAC CAGGTAGCCCTGCTGGCTCTCCAACCTCCACCGAAGAAGGTAC TCTGAAAGCGCAACCCCTGAATCCGGCCCAGGTAGCGAACCG GCAACCTCCGGTTCTGAAACCCCAGGTACTTCTGAAAGCGCTAC | 840 |

TABLE 37-continued

Exemplary GHXTEN comprising growth hormones, XTEN and cleavage sequences

| GHXTEN Name* | Amino Acid Sequence | SEQ ID NO: | DNA Nucleotide Sequence | SEQ ID NO: |
|---|---|---|---|---|
| | TSESATPESGPGTSES ATPESGPGTSESATP ESGPGSEPATSGSET PGSEPATSGSETPGSP AGSPTSTEEGTSTEPS EGSAPGTSTEPSEGS APGSEPATSGSETPG TSESATPESGPGTSTE PSEGSAP | | TCCTGAGTCCGGCCCAGGTAGCCCGGCTGGCTCTCCGACTTCCA CCGAGGAAGGTAGCCCGGCTGGCTCTCCAACTTCTACTGAAGA AGGTACTTCTACCGAACCTTCCGAGGGCAGCGCACCAGGTACT TCTGAAAGCGCTACCCCTGAGTCCGGCCCAGGTACTTCTGAAA GCGCTACTCCTGAATCCGGTCCAGGTACTTCTGAAAGCGCTACC CCGGAATCTGGCCCAGGTAGCGAACCGGCTACTTCTGGTTCTGA AACCCCAGGTAGCGAACCGGCTACCTCCGGTTCTGAAACTCCA GGTAGCCCAGCAGGCTCTCCGACTTCCACTGAGGAAGGTACTT CTACTGAACCTTCCGAAGGCAGCGCACCAGGTACCTCTACTGA ACCTTCTGAGGGCAGCGCTCCAGGTAGCGAACCTGCAACCTCT GGCTCTGAAACCCCAGGTACCTCTGAAAGCGCTACTCCTGAATC TGGCCCAGGTACTTCTACTGAACCGTCCGAGGGCAGCGCACCA | |
| AE624- hGH- Elastase- AE288 | MAEPAGSPTSTEEGT PGSGTASSSPGSSTPS GATGSPGASPGTSST GSPGSPAGSPTSTEE GTSESATPESGPGTS TEPSEGSAPGSPAGS PTSTEEGTSTEPSEGS APGTSTEPSEGSAPG TSESATPESGPGSEP ATSGSETPGSEPATS GSETPGSPAGSPTST EEGTSESATPESGPG TSTEPSEGSAPGTSTE PSEGSAPGSPAGSPT STEEGTSTEPSEGSAP GTSTEPSEGSAPGTS ESATPESGPGTSTEPS EGSAPGTSESATPES GPGSEPATSGSETPG TSTEPSEGSAPGTSTE PSEGSAPGTSESATP ESGPGTSESATPESG PGSPAGSPTSTEEGT SESATPESGPGSEPA TSGSETPGTSESATPE SGPGTSTEPSEGSAP GTSTEPSEGSAPGTS TEPSEGSAPGTSTEPS EGSAPGTSTEPSEGS APGTSTEPSEGSAPG SPAGSPTSTEEGTSTE PSEGSAPGTSESATP ESGPGSEPATSGSET PGTSESATPESGPGS EPATSGSETPGTSES ATPESGPGTSTEPSE GSAPGTSESATPESG PGSPAGSPTSTEEGSP AGSPTSTEEGSPAGS PTSTEEGTSESATPES GPGTSTEPSEGSAPG FPTIPLSRLFDNAML RAHRLHQLAFDTYQ EFEEAYIPKEQKYSF LQNPQTSLCFSESIPT PSNREETQQKSNLEL LRISLLLIQSWLEPVQ FLRSVFANSLVYGAS DSNVYDLLKDLEEGI QTLMGRLEDGSPRT GQIFKQTYSKFDTNS HNDDALLKNYGLLY CFRKDMDKVETFLRI VQCRSVEGSCGFGG GLGPVSGVPGGTSES ATPESGPGSEPATSG SETPGTSESATPESGP GSEPATSGSETPGTS ESATPESGPGTSTEPS EGSAPGSPAGSPTST EEGTSESATPESGPG SEPATSGSETPGTSES | 841 | ATGGCTGAACCTGCTGGCTCTCCAACCTCCACTGAGGAAGGTA CCCCGGGTAGCGGTACTGCTTCTTCCTCTCCAGGTAGCTCTACC CCTTCTGGTGCAACCGGCTCTCCAGGTGCTTCTCCGGGCACCAG CTCTACCGGTTCTCCAGGTAGCCCGGCTGGCTCTCCTACCCTA CTGAGGAAGGTACTTCTGAAAGCGCTACTCCTGAGTCTGGTCCA GGTACCTCTACTGAACCGTCCGAAGGTAGCGCTCCAGGTAGCC CAGCAGGCTCTCCGACTTCCACTGAGGAAGGTACTTCTACTGAA CCTTCCGAAGGCAGCGCACCAGGTACCTCTACTGAACCTTCTGA GGGCAGCGCTCCAGGTACTTCTGAAAGCGCTACCCCGGAATCT GGCCCAGGTAGCGAACCGGCTACTTCTGGTTCTGAAACCCCAG GTAGCGAACCGGCTACCTCCGGTTCTGAAACTCCAGGTAGCCC GGCAGGCTCTCCGACTTCTACTGAGGAAGGTACTTCTGAAAGC AACCCCGGAGTCCGGCCCAGGTACCTCTACCGAACCGTCTG AGGGCAGCGCACCAGGTACTTCTACCGAACCGTCCGAGGGTAG CGCACCAGGTAGCCCAGCAGGTTCTCCTACCTCCACCGAGGAA GGTACTTCTACCGAACCGTCCGAGGGTAGCGCACCAGGTACCT CTACTGAACCTTCTGAGGGCAGCGCTCCAGGTACTTCTGAAAGC GCTACCCCGGAGTCCGGTCCAGGTACTTCTACTGAACCGTCCGA AGGTAGCGAACCAGGTACTTCTGAAAGCGCAACCCCTGAATCC GGTCCAGGTAGCGAACCTGCTGGCTCTCCGAGACTCCAG GTACTTCTACCGAACCGTCCGAAGGTAGCGCACCAGGTACTTCT ACTGAACCGTCTGAAGGTAGCGCACCAGGTACTTCTGAAAGCG CAACCCCGGAATCCGGCCCAGGTACCTCTGAAAGCGCAACCCC GGAGTCCGGCCCAGGTCCTGCTGGCTCTCCAACCTCCACCG AAGAAGGTACTCTGAAAGCGCAACCCCTGAATCCGGCCCAGG TAGCGAACCGGCAACCTCCGGATCTGAAACCCCAGGTACCTCT GAAAGCGCTACTCCGGAGTCTGGCCCAGGTACCTCTACTGAAC CGTCTGAGGGCAGCGCTCCAGGTACTTCTACTGAACCGTCCGAA GGTAGCGCACCAGGTACTTCTACCGAACCGTCCGAAGGCAGCG CTCCAGGTACCTCTACTGAACCTTCCGAGGGCAGCGCTCCAGGT ACCTCTACCGAACCTTCTGAAGGTAGCGCACCAGGTACTTCTAC CGAACCGTCCGAGGGTAGCGCACCAGGTAGCCCAGCAGGTTCT CCTACCTCCACCGAGGAAGGTACTTCTACCGAACCGTCCGAGG GTAGCGCACCAGGTACCTCTGAAAGCGCAACTCCTGAGTCTGG CCCAGGTAGCGAACCTGCTACCTCCGGCTCTGAGACTCCAGGT ACCTCTGAAAGCGCAACCCCGGAATCTGGTCCAGGTAGCGAAC CTGCAACCTCTGGCTCTGAAACCCCAGGTACCTCTGAAAGCGCT ACTCCTGAATCTGGCCCAGGTACTTCTACTGAACCGTCCGAGGG CAGCGCACCAGGTACTTCTGAAAGCGCTACTCCTGAGTCCGGC CCAGGTAGCCCGGCTGGCTCTCCAACTTCTACTGAAGAAGGTA GCCCGGCTGGCTCTCCAACTTCTACTGAAGAAGGTAGCCCGGC AGGCTCTCCGACCTCTACTGAGGAAGGTACTTCTGAAAGCGCA ACCCCGGAGTCCGGCCCAGGTACCTCTACCGAACCGTCTGAGG GCAGCGCACCAGGTTTTCCGACTATTCCGCTGTCTCGTCTGTTT GATAATGCTATGCTGCGTGCGCACCGTCTGCACCAGCTGGCTT TTGATACTTACCAGGAATTTGAAGAAGCcTACATTCCTAAAGAGC AAAAGTACTCTTTCCTGCAAAACCCACAGACTTCTCTCTGCTTC AGCGAATCTATTCCGACGCCTTCCAATCGCGAGGAAACTCAGC AAAAGTCCAATCTGGAACTACTCCGCATTTCTCTGCTTCTGATT CAGAGCTGGCTAGAACCAGTGCAATTTCTGCGTTCCGTCTTCGC CAATAGCCTAGTTTATGGCGCATCCGACAGCAACGTATACGAT CTCCTGAAAGATCTCGAGGAAGGCATTCAGACCCTGATGGGTC GTCTCGAGGATGGCTCTCCGCGTACTGGTCAGATCTTCAAGCAG ACTTACTCTAAATTTGATACTAACAGCCACAATGACGATGCGCT TCTAAAAAACTATGGTCTGCTGTATTGTTTTCGTAAAGATATGG ACAAAGTTGAAACCTTCCTGCGTATTGTTCAGTGTCGTTCCGTT GAGGGCAGCTGTGGTTTCTAAGGTggcggcctgggcgcccggtgagcggcgtgcc gGGTGGTACCTCTGAAAGCGCAACTCCTGAGTCTGGCCCCAGGTA GCGAACCTGCTACCTCCGGCTCTGAGACTCCAGGTACCTCTGAA AGCGCAACCCCGGAATCTGGTCCAGGTAGCGAACCTGCAACCT CTGGCTCTGAAACCCCAGGTACCTCTGAAAGCGCTACTCCTGAA TCTGGCCCAGGTACTTCTACTGAACCGTCCGAGGGCAGCGCAC | 842 |

TABLE 37-continued

Exemplary GHXTEN comprising growth hormones, XTEN and cleavage sequences

| GHXTEN Name* | Amino Acid Sequence | SEQ ID NO: | DNA Nucleotide Sequence | SEQ ID NO: |
|---|---|---|---|---|
| | ATPESGPGSPAGSPT STEEGSPAGSPTSTEE GTSTEPSEGSAPGTS ESATPESGPGTSESA TPESGPGTSESATPES GPGSEPATSGSETPG SEPATSGSETPGSA GSPTSTEEGTSTEPSE GSAPGTSTEPSEGSA PGSEPATSGSETPGT SESATPESGPGTSTEP SEGSAP | | CAGGTAGCCCTGCTGGCTCTCCAACCTCCACCGAAGAAGGTAC CTCTGAAAGCGCAACCCCTGAATCCGGCCCAGGTAGCGAACCG GCAACCTCCGGTTCTGAAACCCAGGTACTTCTGAAAGCGCTAC TCCTGAGTCCGGCCCAGGTAGCCCGGCTGGCTCTCCGACTTCCA CCGAGGAAGGTAGCCCGGCTGGCTCTCCAACTTCTACTGAAGA AGGTACTTCTACCGAACCTTCCGAGGGCAGCGCACCAGGTACT TCTGAAAGCGCTACCCCTGAGTCCGGCCCAGGTACTTCTGAAA GCGCTACTCCTGAATCCGGTCCAGGTACTTCTGAAAGCGCTACC CCGGAATCTGGCCCAGGTAGCGAACCGGCTACTTCTGGTTCTGA AACCCCAGGTAGCGAACCGGCTACCTCCGGTTCTGAAACTCCA GGTAGCCCAGCAGGCTCTCCGACTTCCACTGAGGAAGGTACTT CTACTGAACCTTCCGAAGGCAGCGCACCTCTACTGGA ACCTTCTGAGGGCAGCGCTCCAGGTAGCGAACCTGCAACCTCT GGCTCTGAAACCCCAGGTACCTCTGAAAGCGCTACTCCTGAATC TGGCCCAGGTACTTCTACTGAACCGTCCGAGGGCAGCGCACCA | |
| AE624-hGH-MMP-17-AE288 | MAEPAGSPTSTEEGT PGSGTASSSPGSSTPS GATGSPGASPGTSST GSPGSPAGSPTSTEE GTSESATPESGPGTS TEPSEGSAPGSPAGS PTSTEEGTSTEPSEGS APGTSTEPSEGSAPG TSESATPESGPGSEP ATSGSETPGSEPATS GSETPGSPAGSPTST EEGTSESATPESGPG TSTEPSEGSAPGTSTE PSEGSAPGSPAGSPT STEEGTSTEPSEGSAP GTSTEPSEGSAPGTS ESATPESGPGTSTEPS EGSAPGTSESATPES GPGSEPATSGSETPG TSTEPSEGSAPGTSTE PSEGSAPGTSESATP ESGPGTSESATPESG PGSPAGSPTSTEEGT SESATPESGPGSEPA TSGSETPGTSESATPE SGPGTSTEPSEGSAP GTSTEPSEGSAPGTS TEPSEGSAPGTSTEPS EGSAPGTSTEPSEGS APGTSTEPSEGSAPG SPAGSPTSTEEGTSTE PSEGSAPGTSESATP ESGPGSEPATSGSET PGTSESATPESGPGS EPATSGSETPGTSES ATPESGPGTSTEPSE GSAPGTSESATPESG PGSPAGSPTSTEEGSP AGSPTSTEEGSPAGS PTSTEEGTSESATPES GPGTSTEPSEGSAPG FPTIPLSRLFDNAML RAHRLHQLAFDTYQ EFEEAYIPKEQKYSF LQNPQTSLCFSESIPT PSNREETQQKSNLEL LRISLLLIQSWLEPVQ FLRSVFANSLVYGAS DSNVYDLLKDLEEGI QTLMGRLEDGSPRT GQIFKQTYSKFDTNS HNDDALLKNYGLLY CFRKDMDKVETFLRI VQCRSVEGSCGFGA PLGLRLRGGGGTSES ATPESGPGSEPATSG SETPGTSESATPESGP GSEPATSGSETPGTS ESATPESGPGTSTEPS | 843 | ATGGCTGAACCTGCTGGCTCTCCAACCTCCACTGAGGAAGGTA CCCCGGGTAGCGGTACTGCTTCTTCCTCTCCAGGTAGCTCTACC CCTTCTGGTGCAACCGGCTCTCCAGGTGCTTCTCCGGGCACCAG CTCTACCGGTTCTCCAGGTAGCCCGGCTGGCTCTCCGACTTCTA CTGAGGAAGGTACTTCTGAAAGCGCTACTCCTGAGTCTGGTCCA GGTACCTCTACTGAACCGTCCGAAGGTAGCGCTCCAGGTAGCC CAGCAGGCTCTCCGACTTCCACTGAGGAAGGTACTTCTACTGAA CCTTCCGAAGGCAGCGCACCAGGTACCTCTACTGAACCTTCTGA GGGCAGCGCTCCAGGTACTTCTGAAAGCGCTACCCCGGAATCT GGCCCAGGTAGCGAACCGGCTACTTCTGGTTCTGAAACCCCAG GTAGCGAACCGGCTACCTCCGGTTCTGAAACTCCAGGTAGCCC GGCAGGCTCTCCGACTTCTACTGAGGAAGGTACTTCTGAAAGC TCTACCCCGGAGTCCGGCCCAGGTACCTCTACCGAACCGTCTG AGGGCAGCGCACCAGGTACTTCTACCGAACCGTCCGAGGGTAG CGCACCAGGTAGCCCAGCAGGTTCTCCTACCTCCACCGAGGAA GGTACTTCTACCGAACCGTCCGAGGGTAGCGCACCAGGTACCT CTACTGAACCTTCTGAGGGCAGCGCTCCAGGTACTTCTGAAAGC GCTACCCCGGAGTCCGGTCCAGGTACTTCTACTGAACCGTCCGA AGGTAGCGCACCAGGTACTTCTGAAAGCGCTAACCCCTGAATCC GGTCCAGGTAGCGAACCGGCTACTTCTGGCTCTGAGACTCCAG GTACTTCTACCGAACCGTCTGAAGGTAGCGCACCAGGTTCT ACTGAACCGTCTGAAGGTAGCGCACCAGGTACTTCTGAAAGC CAACCCCGGAATCCGGCCCAGGTACCTCTGAAAGCGCTAACCCC GGAGTCCGGCCCAGGTAGCCCTGCTGGCTCTCCAACCTCCACCG AAGAAGGTACCTCTGAAAGCGCTACCGAACCGTCCGAAGG TAGCGAACCGGCAACCTCCGGTTCTGAAACCCCAGGTACCTCT GAAAGCGCTACTCCGGAGTCTGGCCCAGGTACCTCTACTGAAC CGTCTGAGGGTAGCGCTCCAGGTACTTCTACTGAACCGTCCGAA GGTAGCGCACCAGGTACTTCTGAACCGTCCGAAGGCAGCG CTCCAGGTACCTCTACTGAACCTTCCGAGGGCAGCGCTCCAGGT ACCTCTACCGAACCTTCTGAAGGTAGCGCACCAGGTACTTCTAC CGAACCGTCCGAGGGTAGCGCACCAGGTAGCCCAGCAGGTTCT CCTACCTCCACCGAGGAAGGTACTTCTACCGAACCGTCCGAGG GTAGCGCACCAGGTACCTCTGAAAGCGCTAACCCTGAGTCTGG CCCAGGTAGCGAACCTGCTACCTCCGGCTCTGAGACTCCAGGT ACCTCTGAAAGCGCTAACCCCGGAATCTGGTCCAGGTAGCGAAC CTGCAACCTCCGGCTCTGAAACCCCAGGTACCTCTGAAAGCGCT ACTCCTGAATCTGGCCCAGGTACTTCTACTGAACCGTCCGAGGG CAGCGCACCAGGTACTTCTGAAAGCGCTACTCCTGAGTCCGGC CCAGGTAGCCCGGCTGGCTCTCCGACTTCCACCGAGGAAGGTA GCCCGGCTGGCTCTCCAACTTCTACTGAAGAAGGTAGCCCGGC AGGCTCTCCGACTTCTACTGAGGAAGGTACTTCTGAAAGCGCA ACCCCGGAGTCCGGCCCAGGTACCTCTACCGAACCGTCTGAGG GCAGCGCACCAGGTTTTCCGACTATTCCGCTGTCTCGTCTGTTT GATAATGCTATGCTGCGTGCGCACCGTCTGCACCAGCTGGCCTT TGATACTTACCAGGAATTTGAAGAAGCcTACATTCCTAAAGAGC AGAAGTACTCTTTCCTGCAAAACCCACAGACTTCTCTCTGCTTC AGCGAATCTATTCCGACGCCTTCAATCGCGAGGAAACTCAGC AAAAGTCCAATCTGGAACTACTCCGCATTTCTCTGCTTCTGATT CAGAGCTGGCTAGAACCAGTGCAATTTCTGCGTTCCGTCTTCGC CAATAGCCTAGTTTATGGCGCATCCGACAGCAACGTATACGAT CTCGAATGATCGAGGAAGGCATTCAGACCCTGATGGGTC GTCTCGAGGATGGCTCTCCGCGTACTGGTCAGATCTTCAAGCAG ACTTACTCTAAATTTGATACTAACAGCCACAATGACGATGCGCT TCTAAAAAACTATGGTCTGCTGTATTGTTTTCGTAAAGATATGG ACAAAGTTGAAACCTTCCTGCGTATTGTTCAGTGTCGTTCCGTT GAGGGCAGCTGTGGTTTCTAAGGTgcgccgctgggcctgcgcctgcgcggcgg cGGTGGTACCTCTGAAAGCGCAACTCCTGAGTCTGGCCCAGGTA GCGAACCTGCTACCTCCGGCTCTGAGACTCCAGGTACCTCTGAA | 844 |

TABLE 37-continued

Exemplary GHXTEN comprising growth hormones, XTEN and cleavage sequences

| GHXTEN Name* | SEQ ID NO: | Amino Acid Sequence | DNA Nucleotide Sequence | SEQ ID NO: |
|---|---|---|---|---|
| | | EGSAPGSPAGSPTST EEGTSESATPESGPG SEPATSGSETPGTSES ATPESGPGSPAGSPT STEEGSPAGSPTSTEE GTSTEPSEGSAPGTS ESATPESGPGTSESA TPESGPGTSESATPES GPGSEPATSGSETPG SEPATSGSETPGSPA GSPTSTEEGTSTEPSE GSAPGTSTEPSEGSA PGSEPATSGSETPGT SESATPESGPGTSTEP SEGSAP | AGCGCAACCCCGGAATCTGGTCCAGGTAGCGAACCTGCAACCT CTGGCTCTGAAACCCCAGGTACCTCTGAAAGCGCTACTCCTGAA TCTGGCCCAGGTACTTCTACTGAACCGTCCGAGGGCAGCGCAC CAGGTAGCCCTGCTGGCTCTCCAACCTCCACCGAAGAAGGTAC CTCTGAAAGCGCAACCCCTGAATCCGGCCCAGGTAGCGAACCG GCAACCTCCGGTTCTGAAACCCCAGGTACTTCTGAAAGCGCTAC TCCTGAGTCCGGCCCAGGTAGCCCGGCTGGCTCTCCGACTTCCA CCGAGGAAGGTAGCCCGGCTGGCTCTCCAACTTCTACTGAAGA AGGTACTTCTACCGAACCTTCCGAGGGCAGCGCACCAGGTACT TCTGAAAGCGCTACCCCTGAGTCCGGCCCAGGTACTTCTGAAA GCGCTACTCCTGAATCCGGTCCAGGTACTTCTGAAAGCGCTACC CCGGAATCTGGCCCAGGTAGCGAACCGGCTACTTCTGGTTCTGA AACCCCAGGTAGCGAACCGGCTACCTCCGGTTCTGAAACTCCA GGTAGCCCAGCAGGCTCTCCGACTTCCACTGAGGAAGGTACTT CTACTGAACCTTCCGAAGGCAGCGCACCAGGTACCTCTACTGA ACCTTCTGAGGGCAGCGCTCCAGGTAGCGAACCTGCAACCTCT GGCTCTGAAACCCCAGGTACCTCTGAAAGCGCTACTCCTGAATC TGGCCCAGGTACTTCTACTGAACCGTCCGAGGGCAGCGCACCA | |

*Sequence name reflects N- to C-terminus configuration of the growth factor, cleavage sequence and XTEN components

SEQUENCE LISTING (854 sequences)

SEQ ID NO: 1 - protein, 191 aa, Homo sapiens [sequence omitted]

SEQ ID NO: 2 - protein, 190 aa, Sus sp.
FPAMPLSSLFANAVLRAQHLHQLAADTYKEFERAYIPEGQRYSIQNAQAAFCFSETIPAPTGKDEAQQRSDVELLRFSLLLIQSWLGPVQFLSRVFTNSLVFGTSDRVYEKLKDLEEGIQALMRELEDGSPRAGQILKQTYDKFDTNLRSDDALLKNYGLLSCFKKDLHKAETYLRVMKCRRFVESSCAF

SEQ ID NO: 3 - protein, 190 aa, Vicugna pacos
FPAMPLSSLFANAVLRAQHLHQLAADTYKEFERTYIPEGQRYSIQNAQAAFCFSETIPAPTGKDEAQQRSDVELLRFSLLLIQSWLGPVQFLSRVFTNSLVFGTSDRVYEKLKDLEEGIQALMRELEDGSPRAGQILRQTYDKFDTNLRSDDALLKNYGLLSCFKKDLHKAETYLRVMKCRRFVESSCAF

SEQ ID NO: 4 - protein, 190 aa, Camelus sp.; identical to SEQ ID NO: 3

SEQ ID NO: 5 - protein, 190 aa, Equus ferus
FPAMPLSSLFANAVLRAQHLHQLAADTYKEFERAYIPEGQRYSIQNAQAAFCFSETIPAPTGKDEAQQRSDMELLRFSLLLIQSWLGPVQLLSRVFTNSLVFGTSDRVYEKLRDLEEGIQALMRELEDGSPRAGQILKQTYDKFDTNLRSDDALLKNYGLLSCFKKDLHKAETYLRVMKCRRFVESSCAF

SEQ ID NO: 6 - protein, 190 aa, Unknown
  Description of Unknown: Elephant growth hormone protein
FPAMPLSSLFANAVLRAQHLHQLAADTYKEFERAYIPEGQRYSIQNAQAAFCFSETIPAPTGKDEAQQRSDVELLRFSLLLIQSWLGPVQFLSRVFTNSLVFGTSDRVYEKLKDLEEGIQALMRELEDGSPRPGQVLKQTYDKFDTNMRSDDALLKNYGLLSCFKKDLHKAETYLRVMKCRRFVESSCAF

SEQ ID NO: 7 - protein, 190 aa, Vulpes vulpes
FPAMPLSSLFANAVLRAQHLHQLAADTYKEFERAYIPEGQRYSIQNAQAAFCFSETIPAPTGKDEAQQRSDVELLRFSLVLIQSWLGPLQFLSRVFTNSLVFGTSDRVYEKLKDLEEGIQALMRELEDGSPRAGQILKQTYDKFDTNLRSDDALLKNYGLLSCFKKDLHKAETYLRVMKCRRFVESSCAF

SEQ ID NO: 8 - protein, 190 aa, Canis familiaris; identical to SEQ ID NO: 2

SEQ ID NO: 9 - protein, 190 aa, Felis catus
FPAMPLSSLFANAVLRAQHLHQLAADTYKEFERAYIPEGQRYSIQNAQAAFCFSETIPAPTGKDEAQQRSDVELLRFSLLLIQSWLGPVQFLSRVFTNSLVFGTSDRVYEKLKDLEEGIQALMRELEDGSPRGGQILKQTYDKFDTNLRSDDALLKNYGLLSCFKKDLHKAETYLRVMKCRRFVESSCAF

SEQ ID NO: 10 - protein, 190 aa, Neovison vison
FPAMPLSSLFANAVLRAQHLHQLAADTYKDFERAYIPEGQRYSIQNAQAAFCFSETIPAPTGKDEAQQRSDMELLRFSLLLIQSWLGPVQFLSRVFTNSLVFGTSDRVYEKLKDLEEGIQALMRELEDGSPRAGPILKQTYDKFDTNLRSDDALLKNYGLLSCFKKDLHKAETYLRVMKCRRFVESSCAF

SEQ ID NO: 11 - protein, 190 aa, Balaenoptera physalus
FPAMPLSSLFANAVLRAQHLHQLAADTYKEFERAYIPEGQRYSIQNAQAAFCFSETIPAPTGKDEAQQRSDVELLRFSLLLIQSWLGPVQFLSRVFTNSLVFGTSDRVYEKLKDLEEGIQALMRELEDGSPRAGQILKQTYDKFDTNMRSDDALLKNYGLLSCFKKDLHKAETYLRVMKCRRFVESSCAF

SEQ ID NO: 12 - protein, 190 aa, Unknown
  Description of Unknown: Dolphin growth hormone protein
FPAMPLSSLFANAVLRAQHLHQLAADTYKEFERAYIPEGQRYSIQNTQAAFCFSETIPAPTGKDEAQQRSDVELLRFSLLLIQSWLGPVQFLSRVFTNSLVFGTSDRVYEKLKDLEEGIQALMRELEDGSPRAGQILKQTYDKFDTNMRSDDALLKNYGLLSCFKKDLHKAETYLRVMKCRRFVESSCAF

SEQ ID NO: 13 - protein, 190 aa, Hippopotamus amphibius; identical to SEQ ID NO: 12

SEQ ID NO: 14 - protein, 190 aa, Unknown
  Description of Unknown: Rabbit growth hormone protein
FPAMPLSSLFANAVLRAQHLHQLAADTYKEFERAYIPEGQRYSIQNAQAAFCFSETIPAPTGKDEAQQRSDMELLRFSLLLIQSWLGPVQFLSRAFTNTLVFGTSDRVYEKLKDLEEGIQALMRELEDGSPRVGQLLKQTYDKFDTNLRGDDALLKNYGLLSCFKKDLHKAETYLRVMKCRRFVESSCVF

SEQ ID NO: 15 - protein, 190 aa, Rattus sp.
FPAMPLSSLFANAVLRAQHLHQLAADTYKEFERAYIPEGQRYSIQNAQAAFCFSETIPAPTGKEEAQQRTDMELLRFSLLLIQSWLGPVQFLSRIFTNSLMFGTSDRVYEKLKDLEEGIQALMQELEDGSPRIGQILKQTYDKFDANMRSDDALLKNYGLLSCFKKDLHKAETYLRVMKCRRFAESSCAF

SEQ ID NO: 16 - protein, 190 aa, Mus sp.
FPAMPLSSLFSNAVLRAQHLHQLAADTYKEFERAYIPEGQRYSIQNAQAAFCFSETIPAPTGKEEAQQRTDMELLRFSLLLIQSWLGPVQFLSRIFTNSLMFGTSDRVYEKLKDLEEGIQALMQELEDGSPRVGQILKQTYDKFDANMRSDDALLKNYGLLSCFKKDLHKAETYLRVMKCRRFVESSCAF

SEQ ID NO: 17 - protein, 190 aa, Unknown
  Description of Unknown: Hamster growth hormone protein
FPAMPLSSLFANAVLRAQHLHQLAADTYKEFERAYIPEGQRYSIQNAQTAFCFSETIPAPTGKEEAQQRSDMELLRFSLLLIQSWLGPVQFLSRIFTNSLMFGTSDRVYEKLKDLEEGIQALMQELEDGSPRVGQILKQTYDKFDTNMRSDDALLKNYGLLSCFKKDLHKAETYLRVMKCRRFVESSCAF

SEQ ID NO: 18 - protein, 190 aa, Unknown
  Description of Unknown: Mole rat growth hormone protein
FPAMPLSNLFANAVLRAQHLHQLAADTYKEFERAYIPEGQRYSIQNAQAAFCFSETIPAPTGKEEAQQRSDMELLRFSLLLIQSWLGPVQFLSRVFTNSLVFGTSDRVFEKLKDLEEGIQALMRELEDGSLRAGQLLKQTYDKFDTNMRSDDALLKNYGLLSCFKKDLHKAETYLRVMKCRRFVESSCAF

SEQ ID NO: 19 - protein, 190 aa, Cavia porcellus
FPAMPLSSLFGNAVLRAQHLHQLAADTYKEFERTYIPEGQRYSIHNTQTAFCFSETIPAPTDKEEAQQRSDVELLHFSLLLIQSWLGPVQFLSRVFTNSLVFGTSDRVYEKLKDLEEGIQALMRELEDGTPRAGQILKQTYDKFDTNLRSNDALLKNYGLLSCFRKDLHRTETYLRVMKCRRFVESSCAF

SEQ ID NO: 20 - protein, 191 aa, Unknown
  Description of Unknown: Ox growth hormone protein
AFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTNSLVFGTSDRVYEKLKDLEEGILALMRELEDGTPRAGQILKQTYDKFDTNMRSDDALLKNYGLLSCFRKDLHKTETYLRVMKCRRFGEASCAF

SEQ ID NO: 21 - protein, 191 aa, Unknown
  Description of Unknown: Sheep or Goat growth hormone protein
AFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTNSLVFGTSDRVYEKLKDLEEGILALMRELEDVTPRAGQILKQTYDKFDTNMRSDDALLKNYGLLSCFRKDLHKTETYLRVMKCRRFGEASCAF

SEQ ID NO: 22 - protein, 190 aa, Cervus elaphus
FPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTNSLVFGTSDRVYEKLKDLEEGILALMRELEDGTPRAGQILKQTYDKFDTNMRSDDALLKNYGLLSCFRKDLHKTETYLRVMKCRRFGEASCAF

SEQ ID NO: 23 - protein, 191 aa, Giraffa camelopardalis
AFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFSNSLVFGTSDRVYEKLKDLEEGILALMRELEDGTPRAGQILKQTYDKFDTNMRSDDALLKNYGLLSCFRKDLHKTETYLRVMKCRRFGEASCAF

SEQ ID NO: 24 - protein, 190 aa, Unknown
  Description of Unknown: Chevrotain-1 growth hormone protein
FPAMSLSGLFANAVLRVQHLHQLAADTFKEFERTYIPEGQRYSIQNTQVAFCFSETIPAPTGKNEAQQKSDLELLRISLLLIQSWLGPLQFLSRVFTNSLVFGTSDRVYEKLKDLEEGILALMRELEDGPPRAGQILKQTYDKFDTNMRSDDALLKNYGLLSCFRKDLHKTETYLRVMKCRRFGEASCAF

SEQ ID NO: 25 - protein, 190 aa, Unknown
  Description of Unknown: Slow loris growth hormone protein
FPAMPLSSLFANAVLRAQHLHQLAADTYKEFERAYIPEGQRYSIQNAQAAFCFSETIPAPTGKDEAQQRSDMELLRFSLLLIQSWLGPVQLLSRVFTNSLVLGTSDRVYEKLKDLEEGIQALMRELEDGSPRVGQILKQTYDKFDTNLRSDDALLKNYGLLSCFKKDLHKAETYLRVMKCRRFVESSCAF

SEQ ID NO: 26 - protein, 191 aa, Unknown
  Description of Unknown: Marmoset growth hormone protein
FPTIPLSRLLDNAMLRAHRLHQLAFDTYQEFEEAYIPKEQKYSFLQNPQTSLCFSESIPTPASKKETQQKSNLELLRMSLLLIQSWFEPVQFLRSVFANSLLYGVSDSDVYEYLKDLEEGIQTLMGRLEDGSPRTGEIFMQTYRKFDVNSQNNDALLKNYGLLYCFRKDMDKVETFLRIVQCRSVEGSCGF

SEQ ID NO: 27 - protein, 190 aa, Unknown
  Description of Unknown: BrTailed Possum growth hormone protein
FPAMPLSSLFANAVLRAQHLHQLVADTYKEFERTYIPEAQRHSIQSTQTAFCFSETIPAPTGKDEAQQRSDVELLRFSLLLIQSWLSPVQFLSRVFTNSLVFGTSDRVYEKLRDLEEGIQALMQELEDGSSRGGLVLKTTYDKFDTNLRSDEALLKNYGLLSCFKKDLHKAETYLRVMKCRRFVESSCAF

SEQ ID NO: 28 - protein, 191 aa, Macaca mulatta
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGTSYSDVYDLLKDLEEGIQTLMGRLEDGSSRTGQIFKQTYSKFDTNSHNNDALLKNYGLLYCFRKDMDKIETFLRIVQCRSVEGSCGF

SEQ ID NO: 29 - protein, 12 aa, Artificial Sequence
  Description of Artificial Sequence: Synthetic peptide
GESPGGSSGSES

SEQ ID NO: 30 - protein, 12 aa, Artificial Sequence
  Description of Artificial Sequence: Synthetic peptide
GSEGSSGPGESS

SEQ ID NO: 31 - protein, 12 aa, Artificial Sequence
  Description of Artificial Sequence: Synthetic peptide
GSSESGSSEGGP

SEQ ID NO: 32 - protein, 12 aa, Artificial Sequence
  Description of Artificial Sequence: Synthetic peptide
GSGGEPSESGSS

SEQ ID NO: 33 - protein, 12 aa, Artificial Sequence
  Description of Artificial Sequence: Synthetic peptide
GSPAGSPTSTEE

SEQ ID NO: 34 - protein, 12 aa, Artificial Sequence
  Description of Artificial Sequence: Synthetic peptide
GSEPATSGSETP

SEQ ID NO: 35 - protein, 12 aa, Artificial Sequence
  Description of Artificial Sequence: Synthetic peptide
GTSESATPESGP

SEQ ID NO: 36 - protein, 12 aa, Artificial Sequence
  Description of Artificial Sequence: Synthetic peptide
GTSTEPSEGSAP

SEQ ID NO: 37 - protein, 12 aa, Artificial Sequence
  Description of Artificial Sequence: Synthetic peptide
GSTSESPSGTAP

SEQ ID NO: 38 - protein, 12 aa, Artificial Sequence
  Description of Artificial Sequence: Synthetic peptide
GTSTPESGSASP

SEQ ID NO: 39 - protein, 12 aa, Artificial Sequence
  Description of Artificial Sequence: Synthetic peptide
GTSPSGESSTAP

SEQ ID NO: 40 - protein, 12 aa, Artificial Sequence
  Description of Artificial Sequence: Synthetic peptide
GSTSSTAESPGP

SEQ ID NO: 41 - protein, 12 aa, Artificial Sequence
  Description of Artificial Sequence: Synthetic peptide
GTPGSGTASSSP

SEQ ID NO: 42 - protein, 12 aa, Artificial Sequence
  Description of Artificial Sequence: Synthetic peptide
GSSTPSGATGSP

SEQ ID NO: 43 - protein, 12 aa, Artificial Sequence
  Description of Artificial Sequence: Synthetic peptide
GSSPSASTGTGP

SEQ ID NO: 44 - protein, 12 aa, Artificial Sequence
  Description of Artificial Sequence: Synthetic peptide
GASPGTSSTGSP

SEQ ID NO: 45 - protein, 12 aa, Artificial Sequence
  Description of Artificial Sequence: Synthetic peptide
GEPAGSPTSTSE

SEQ ID NO: 46 - protein, 12 aa, Artificial Sequence
  Description of Artificial Sequence: Synthetic peptide
GTGEPSSTPASE

SEQ ID NO: 47 - protein, 12 aa, Artificial Sequence
  Description of Artificial Sequence: Synthetic peptide
GSGPSTESAPTE

SEQ ID NO: 48 - protein, 12 aa, Artificial Sequence
  Description of Artificial Sequence: Synthetic peptide
GSETPSGPSETA

SEQ ID NO: 49 - protein, 12 aa, Artificial Sequence
  Description of Artificial Sequence: Synthetic peptide
GPSETSTSEPGA

SEQ ID NO: 50 - protein, 12 aa, Artificial Sequence
  Description of Artificial Sequence: Synthetic peptide
GSPSEPTEGTSA

SEQ ID NO: 51 - protein, 12 aa, Artificial Sequence
  Description of Artificial Sequence: Synthetic peptide
GSGASEPTSTEP

SEQ ID NO: 52 - protein, 12 aa, Artificial Sequence
  Description of Artificial Sequence: Synthetic peptide
GSEPATSGTEPS

SEQ ID NO: 53 - protein, 12 aa, Artificial Sequence
  Description of Artificial Sequence: Synthetic peptide
GTSEPSTSEPGA

SEQ ID NO: 54 - protein, 12 aa, Artificial Sequence
  Description of Artificial Sequence: Synthetic peptide
GTSTEPSEPGSA

SEQ ID NO: 55 - protein, 12 aa, Artificial Sequence
  Description of Artificial Sequence: Synthetic peptide
GSTAGSETSTEA

SEQ ID NO: 56 - protein, 12 aa, Artificial Sequence
  Description of Artificial Sequence: Synthetic peptide
GSETATSGSETA

SEQ ID NO: 57 - protein, 12 aa, Artificial Sequence
  Description of Artificial Sequence: Synthetic peptide
GTSESATSESGA

SEQ ID NO: 58 - protein, 12 aa, Artificial Sequence
  Description of Artificial Sequence: Synthetic peptide
GTSTEASEGSAS

SEQ ID NO: 59 - protein, 48 aa, Artificial Sequence
  Description of Artificial Sequence: Synthetic polypeptide
MAEPAGSPTSTEEGTPGSGTASSSPGSSTPSGATGSPGASPGTSSTGS

SEQ ID NO: 60 - protein, 48 aa, Artificial Sequence
  Description of Artificial Sequence: Synthetic polypeptide
MAEPAGSPTSTEEGASPGTSSTGSPGSSTPSGATGSPGSSTPSGATGS

SEQ ID NO: 61 - protein, 144 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 62 - protein, 144 aa, Artificial Sequence
  Description of Artificial Sequence: Synthetic polypeptide
GTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAP

SEQ ID NO: 63 - protein, 288 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 64 - protein, 504 aa, Artificial Sequence
  Description of Artificial Sequence: Synthetic polypeptide
  MOD_RES (63)..(63): Any amino acid
  MOD_RES (207)..(207): Any amino acid
GASPGTSSTGSPGSSPSASTGTGPGSSPSASTGTGPGTPGSGTASSSPGSSTPSGATGSPGSXPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSXPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSP

SEQ ID NO: 65 - protein, 540 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAP

SEQ ID NO: 66 - protein, 576 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESS

SEQ ID NO: 67 - protein, 576 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 68 - protein, 576 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASP

SEQ ID NO: 69 - protein, 625 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 70 - protein, 836 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSS

SEQ ID NO: 71 - protein, 864 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 72 - protein, 875 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 73 - protein, 864 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 74 - protein, 875 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 75 - protein, 913 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 76 - protein, 924 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 77 - protein, 1318 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 78 - protein, 864 aa, Artificial Sequence
  Description of Artificial Sequence: Synthetic polypeptide
GTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSA

SEQ ID NO: 79 - protein, 864 aa, Artificial Sequence
  Description of Artificial Sequence: Synthetic polypeptide
GSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETA

SEQ ID NO: 80 - protein, 48 aa, Artificial Sequence; identical to SEQ ID NO: 59
  Description of Artificial Sequence: Synthetic polypeptide

SEQ ID NO: 81 - protein, 48 aa, Artificial Sequence; identical to SEQ ID NO: 60
  Description of Artificial Sequence: Synthetic polypeptide

SEQ ID NO: 82 - protein, 8 aa, Artificial Sequence
  Description of Artificial Sequence: Synthetic peptide
LTPRSLLV

SEQ ID NO: 83 - protein, 8 aa, Artificial Sequence
  Description of Artificial Sequence: Synthetic peptide
LTPRSLLV

SEQ ID NO: 84 - protein, 8 aa, Artificial Sequence
  Description of Artificial Sequence: Synthetic peptide
KLTRVVGG

SEQ ID NO: 85 - protein, 8 aa, Artificial Sequence
  Description of Artificial Sequence: Synthetic peptide
TMTRIVGG

SEQ ID NO: 86 - protein, 8 aa, Artificial Sequence
  Description of Artificial Sequence: Synthetic peptide
SPFRSTGG

SEQ ID NO: 87 - protein, 8 aa, Artificial Sequence
  Description of Artificial Sequence: Synthetic peptide
LQVRIVGG

SEQ ID NO: 88 - protein, 8 aa, Artificial Sequence
  Description of Artificial Sequence: Synthetic peptide
PLGRIVGG

SEQ ID NO: 89 - protein, 8 aa, Artificial Sequence
  Description of Artificial Sequence: Synthetic peptide
IEGRTVGG

SEQ ID NO: 90 - protein, 8 aa, Artificial Sequence
  Description of Artificial Sequence: Synthetic peptide
LTPRSLLV

SEQ ID NO: 91 - protein, 8 aa, Artificial Sequence
  Description of Artificial Sequence: Synthetic peptide
LGPVSGVP

SEQ ID NO: 92 - protein, 8 aa, Artificial Sequence
  Description of Artificial Sequence: Synthetic peptide
VAGDSLEE

SEQ ID NO: 93 - protein, 8 aa, Artificial Sequence
  Description of Artificial Sequence: Synthetic peptide
GPAGLGGA

SEQ ID NO: 94 - protein, 8 aa, Artificial Sequence
  Description of Artificial Sequence: Synthetic peptide
  MOD_RES (2)..(2): Pro or Ala
  MOD_RES (3)..(3): Any amino acid
  MOD_RES (6)..(6): Any amino acid
  MOD_RES (8)..(8): Any amino acid
GXXGLXGX

SEQ ID NO: 95 - protein, 8 aa, Artificial Sequence
  Description of Artificial Sequence: Synthetic peptide
GPAGLRGA

SEQ ID NO: 96 - protein, 8 aa, Artificial Sequence
  Description of Artificial Sequence: Synthetic peptide
  MOD_RES (3)..(3): Any amino acid
  MOD_RES (6)..(6): Any amino acid
  MOD_RES (7)..(7): Gly or Ala
  MOD_RES (8)..(8): Any amino acid
GPXGLXXX

SEQ ID NO: 97 - protein, 8 aa, Artificial Sequence
  Description of Artificial Sequence: Synthetic peptide
APLGLRLR

SEQ ID NO: 98 - protein, 8 aa, Artificial Sequence
  Description of Artificial Sequence: Synthetic peptide
PALPLVAQ

SEQ ID NO: 99 - protein, 7 aa, Artificial Sequence
  Description of Artificial Sequence: Synthetic peptide
ENLYFQG

SEQ ID NO: 100 - protein, 8 aa, Artificial Sequence
  Description of Artificial Sequence: Synthetic peptide
ENLYFQGS

SEQ ID NO: 101 - protein, 8 aa, Artificial Sequence
  Description of Artificial Sequence: Synthetic peptide
DDDKIVGG

SEQ ID NO: 102 - protein, 8 aa, Artificial Sequence
  Description of Artificial Sequence: Synthetic peptide
DDDKIVGG

SEQ ID NO: 103 - protein, 8 aa, Artificial Sequence
  Description of Artificial Sequence: Synthetic peptide
LEVLFQGP

SEQ ID NO: 104 - protein, 8 aa, Artificial Sequence
  Description of Artificial Sequence: Synthetic peptide
LEVLFQGP

SEQ ID NO: 105 - protein, 8 aa, Artificial Sequence
  Description of Artificial Sequence: Synthetic peptide
LPKTGSES

SEQ ID NO: 106 - protein, 8 aa, Artificial Sequence
  Description of Artificial Sequence: Synthetic peptide
  MOD_RES (3)..(3): Lys, Glu, Ala or Asp
  MOD_RES (6)..(6): Any amino acid
  MOD_RES (7)..(7): Glu, Lys or Ser
LPXTGXXS

SEQ ID NO: 107 - DNA, 144 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttct

SEQ ID NO: 108 - DNA, 144 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctct

SEQ ID NO: 109 - DNA, 432 bp, Artificial Sequence
  Description of Artificial Sequence: Synthetic polynucleotide
ggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 110 - DNA, 432 bp, Artificial Sequence
  Description of Artificial Sequence: Synthetic polynucleotide
ggtacttctactccggaaagcggttccgcatctccaggtacttctcctagcggtgaatcttctactgctccaggtacctctcctagcggcgaatcttctactgctccaggttctaccagctctaccgctgaatctcctggcccaggttctaccagcgaatccccgtctggcaccgcaccaggttctactagctctaccgcagaatctccgggtccaggtacttcccctagcggtgaatcttctactgctccaggtacctctactccggaaagcggctccgcatctccaggttctactagctctactgctgaatctcctggtccaggtacctcccctagcggcgaatcttctactgctccaggtacctctcctagcggcgaatcttctaccgctccaggtacctcccctagcggtgaatcttctaccgcacca

SEQ ID NO: 111 - DNA, 864 bp, Artificial Sequence
  Description of Artificial Sequence: Synthetic polynucleotide
ggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 112 - DNA, 1728 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcacca

SEQ ID NO: 113 - DNA, 1728 bp, Artificial Sequence
  Description of Artificial Sequence: Synthetic polynucleotide
ggttctactagctctaccgctgaatctcctggcccaggttccactagctctaccgcagaatctccgggcccaggttctactagcgaatccccttctggtaccgctccaggttctactagctctaccgctgaatctccgggtccaggttctaccagctctactgcagaatctcctggcccaggtacttctactccggaaagcggttccgcttctccaggttctaccagcgaatctccttctggcaccgctccaggtacctctcctagcggcgaatcttctaccgctccaggttctactagcgaatctccttctggcactgcaccaggttctaccagcgaatctccttctggcaccgctccaggtacctctcctagcggcgaatcttctaccgctccaggttctactagcgaatctccttctggcactgcaccaggttctaccagcgaatctccttctggcaccgctccaggtacctctcctagcggcgaatcttctaccgctccaggttctactagcgaatctccttctggcactgcaccaggttctactagcgaatctccttctggcactgcaccaggttctaccagcgaatctccgtctggcactgcaccaggtacctctacccctgaaagcggttccgcttctccaggttctactagcgaatctccttctggtaccgctccaggtacttctacccctgaaagcggctccgcttctccaggttccactagctctaccgctgaatctccgggtccaggttctactagctctactgcagaatctcctggcccaggtacctctactccggaaagcggctctgcatctccaggtacttctacccctgaaagcggttctgcatctccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggttctaccagcgaatccccgtctggtactgctccaggttctaccagcgaatctccttctggtactgcaccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctactagcgaatctccttctggcactgcaccaggttctaccagcgaatctccgtctggcactgcaccaggtacctctacccctgaaagcggttccgcttctccaggtacttctccgagcggtgaatcttctaccgcaccaggttctactagctctaccgctgaatctccgggcccaggtacttctccgagcggtgaatcttctactgctccaggttccactagctctactgctgaatctcctggcccaggtacttctactccggaaagcggttccgcttctccaggttctactagcgaatctccgtctggcaccgcaccaggttctactagctctactgcagaatctcctggcccaggtacctctactccggaaagcggctctgcatctccaggtacttctacccctgaaagcggttctgcatctcca

SEQ ID NO: 114 - DNA, 1875 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcacca

SEQ ID NO: 115 - DNA, 2625 bp, Artificial Sequence
  Description of Artificial Sequence: Synthetic polynucleotide
ggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcacca

SEQ ID NO: 116 - DNA, 2592 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 117 - DNA, 2625 bp, Artificial Sequence
  Description of Artificial Sequence: Synthetic polynucleotide
  modified_base (1287)..(1298): a, c, t, g, unknown or other
  modified_base (1330)..(1337): a, c, t, g, unknown or other
ggttctaccagcgaatctccttctggcaccgctccaggtacctctcctagcggcgaatcttctaccgctccaggttctactagcgaatctccttctggcactgcaccaggttctactagcgaatccccgtctggtactgctccaggtacttctactcctgaaagcggttccgcttctccaggtacctctactccggaaagcggttctgcatctccaggttctaccagcgaatctccttctggcaccgctccaggttctactagcgaatccccgtctggtaccgcaccaggtacttctcctagcggcgaatcttctaccgcaccaggttctactagcgaatctccgtctggcactgctccaggtacttctcctagcggtgaatcttctaccgctccaggtacttcccctagcggcgaatcttctaccgctccaggttctactagctctactgcagaatctccgggcccaggtacctctcctagcggtgaatcttctaccgctccaggtacttctccgagcggtgaatcttctaccgctccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctaccagctctaccgcagaatctcctggtccaggtacctctactccggaaagcggctctgcatctccaggttctactagcgaatctccttctggcactgcaccaggtacttctccgagcggtgaatcttctaccgcaccaggttctactagctctaccgctgaatctccgggcccaggtacttctccgagcggtgaatcttctactgctccaggtacctctactcctgaaagcggttctgcatctccaggttccactagctctaccgcagaatctccgggcccaggttctactagctctactgctgaatctcctggcccaggttctactagctctactgctgaatctccgggtccaggttctaccagctctactgctgaatctcctggtccaggtacctccccgagcggtgaatcttctactgcaccaggttctactagcgaatctccttctggcactgcaccaggttctaccagcgaatctccgtctggcactgcaccaggtacctctacccctgaaagcggtccnnnnnnnnnnnntgcaagcgcaagcggcgcgccaagcacgggannnnnnnntagcgaatctccttctggtaccgctccaggttctaccagcgaatccccgtctggtactgctccaggttctaccagcgaatctccttctggtactgcaccaggttctactagcgaatctccttctggtaccgctccaggttctaccagcgaatccccgtctggtactgctccaggttctaccagcgaatctccttctggtactgcaccaggtacttctactccggaaagcggttccgcatctccaggtacttctcctagcggtgaatcttctactgctccaggtacctctcctagcggcgaatcttctactgctccaggttctaccagctctactgctgaatctccgggtccaggtacttccccgagcggtgaatcttctactgcaccaggtacttctactccggaaagcggttccgcttctccaggttctaccagcgaatctccttctggcaccgctccaggttctactagcgaatccccgtctggtaccgcaccaggtacttctcctagcggcgaatcttctaccgcaccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggtacttctacccctgaaagcggctccgcttctccaggttccactagctctaccgctgaatctccgggtccaggttctaccagcgaatctccttctggcaccgctccaggttctactagcgaatccccgtctggtaccgcaccaggtacttctcctagcggcgaatcttctaccgcaccaggttctaccagctctactgctgaatctccgggtccaggtacttccccgagcggtgaatcttctactgcaccaggtacttctactccggaaagcggttccgcttctccaggtacctcccctagcggcgaatcttctactgctccaggtacctctcctagcggcgaatcttctaccgctccaggtacctcccctagcggtgaatcttctaccgcaccaggttctactagctctactgctgaatctccgggtccaggttctaccagctctactgctgaatctcctggtccaggtacctccccgagcggtgaatcttctactgcaccaggttctagcccttctgcttccaccggtaccggcccaggtagctctactccgtctggtgcaactggctctccaggtagctctactccgtctggtgcaaccggctcccca

SEQ ID NO: 118 - DNA, 2592 bp, Artificial Sequence
  Description of Artificial Sequence: Synthetic polynucleotide
ggtgcttccccgggcaccagctctactggttctccaggttctagcccgtctgcttctactggtactggtccaggttctagcccttctgcttccactggtactggtccaggtaccccgggtagcggtaccgcttcttcttctccaggtagctctactccgtctggtgctaccggctctccaggttctaacccttctgcatccaccggtaccggcccaggtgcttctccgggcaccagctctactggttctccaggtaccccgggcagcggtaccgcatcttcttctccaggtagctctactccttctggtgcaactggttctccaggtactcctggcagcggtaccgcttcttcttctccaggtgcttctcctggtactagctctactggttctccaggtgcttctccgggcactagctctactggttctccaggtaccccgggtagcggtactgcttcttcctctccaggtagctctaccccttctggtgcaaccggctctccaggtgcttctccgggcaccagctctaccggttctccaggtaccccgggtagcggtaccgcttcttcttctccaggtagctctactccgtctggtgctaccggctctccaggttctaacccttctgcatccaccggtaccggcccaggttctagcccttctgcttccaccggtactggcccaggtagctctaccccttctggtgctaccggctccccaggtagctctactccttctggtgcaactggctctccaggtgcatctccgggcactagctctactggttctccaggtgcatcccctggcactagctctactggttctccaggtgcttctcctggtaccagctctactggttctccaggtactcctggcagcggtaccgcttcttcttctccaggtgcttctcctggtactagctctactggttctccaggtgcttctccgggcactagctctactggttctccaggtgcttccccgggcactagctctaccggttctccaggttctagcccttctgcatctactggtactggcccaggtactccgggcagcggtactgcttcttcctctccaggtgcatctccgggcactagctctactggttctccaggtgcatcccctggcactagctctactggttctccaggtgcttctcctggtaccagctctactggttctccaggtagctctactccgtctggtgcaaccggttccccaggtagctctactccttctggtgctactggctccccaggtgcatcccctggcaccagctctaccggttctccaggtaccccgggcagcggtaccgcatcttcctctccaggtagctctaccccgtctggtgctaccggttccccaggtagctctaccccgtctggtgcaaccggctccccaggtagctctactccgtctggtgcaaccggctccccaggttctagcccgtctgcttccactggtactggcccaggtgcttccccgggcaccagctctactggttctccaggtgcatccccgggtaccagctctaccggttctccaggtactcctggcagcggtactgcatcttcctctccaggtgcttctccgggcaccagctctactggttctccaggtgcatctccgggcactagctctactggttctccaggtgcatcccctggcactagctctactggttctccaggtgcttctcctggtaccagctctactggttctccaggtacccctggtagcggtactgcttcttcctctccaggtagctctactccgtctggtgctaccggttctccaggtaccccgggtagcggtaccgcatcttcttctccaggtagctctaccccgtctggtgctactggttctccaggtactccgggcagcggtactgcttcttcctctccaggtagctctaccccttctggtgctactggctctccaggtagctctaccccgtctggtgctactggctccccaggttctagcccttctgcatccaccggtaccggtccaggttctagcccgtctgcatctactggtactggtccaggtgcatccccgggcactagctctaccggttctccaggtactcctggtagcggtactgcttcttcttctccaggtagctctactccttctggtgctactggttctccaggttctagcccttctgcatccaccggtaccggcccaggttctagcccgtctgcttctaccggtactggtccaggtgcttctccgggtactagctctactggttctccaggtgcatctcctggtactagctctactggttctccaggtagctctactccgtctggtgcaaccggctctccaggttctagcccttctgcatctaccggtactggtccaggtgcatcccctggtaccagctctaccggttctccaggttctagcccttctgcttctaccggtaccggtccaggtacccctggcagcggtaccgcatcttcctctccaggtagctctactccgtctggtgcaaccggttccccaggtagctctactccttctggtgctactggctccccaggtgcatcccctggcaccagctctaccggttctcca

SEQ ID NO: 119 - DNA, 2772 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcacca

SEQ ID NO: 120 - DNA, 2739 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 121 - DNA, 3954 bp, Artificial Sequence
  Description of Artificial Sequence: Synthetic polynucleotide
ggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtccagaaccaacggggccggccccaagcggaggtagcgaaccggcaacctccggctctgaaaccccaggtacctctgaaagcgctactcctgaatccggcccaggtagcccggcaggttctccgacttccactgaggaaggtacttctgaaagcgctactcctgagtccggcccaggtagcccggctggctctccgacttccaccgaggaaggtagcccggctggctctccaacttctactgaagaaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggttctaccagcgaatctccttctggcaccgctccaggttctactagcgaatccccgtctggtaccgcaccaggtacttctcctagcggcgaatcttctaccgcaccaggtacttctaccgaaccttccgagggcagcgcaccaggtacttctgaaagcgctacccctgagtccggcccaggtacttctgaaagcgctactcctgaatccggtccaggtagcgaaccggcaacctctggctctgaaaccccaggtacctctgaaagcgctactccggaatctggtccaggtacttctgaaagcgctactccggaatccggtccaggtacctctactgaaccttctgagggcagcgctccaggtacttctgaaagcgctaccccggagtccggtccaggtacttctactgaaccgtccgaaggtagcgcaccaggtacctcccctagcggcgaatcttctactgctccaggtacctctcctagcggcgaatcttctaccgctccaggtacctcccctagcggtgaatcttctaccgcaccaggtacttctaccgaaccgtccgagggtagcgcaccaggtagcccagcaggttctcctacctccaccgaggaaggtacttctaccgaaccgtccgagggtagcgcaccaggttctagcccttctgcttccaccggtaccggcccaggtagctctactccgtctggtgcaactggctctccaggtagctctactccgtctggtgcaaccggctccccaggtagctctaccccgtctggtgctaccggctctccaggtagctctaccccgtctggtgcaaccggctccccaggtgcatccccgggtactagctctaccggttctccaggtgcaagcgcaagcggcgcgccaagcacgggaggtacttctccgagcggtgaatcttctaccgcaccaggttctactagctctaccgctgaatctccgggcccaggtacttctccgagcggtgaatcttctactgctccaggtacctctgaaagcgctactccggagtctggcccaggtacctctactgaaccgtctgagggtagcgctccaggtacttctactgaaccgtccgaaggtagcgcaccaggttctagcccttctgcatctactggtactggcccaggtagctctactccttctggtgctaccggctctccaggtgcttctccgggtactagctctaccggttctccaggtacttctactccggaaagcggttccgcatctccaggtacttctcctagcggtgaatcttctactgctccaggtacctctcctagcggcgaatcttctactgctccaggtacttctgaaagcgcaacccctgaatccggtccaggtagcgaaccggctacttctggctctgagactccaggtacttctaccgaaccgtccgaaggtagcgcaccaggttctaccagcgaatccccttctggtactgctccaggttctaccagcgaatccccttctggcaccgcaccaggtacttctacccctgaaagcggctccgcttctccaggtagcccggcaggctctccgacctctactgaggaaggtacttctgaaagcgcaaccccggagtccggcccaggtacctctaccgaaccgtctgagggcagcgcaccaggtagccctgctggctctccaacctccaccgaagaaggtacctctgaaagcgcaacccctgaatccggcccaggtagcgaaccggcaacctccggttctgaaaccccaggtagctctaccccgtctggtgctaccggttccccaggtgcttctcctggtactagctctaccggttctccaggtagctctaccccgtctggtgctactggctctccaggttctactagcgaatccccgtctggtactgctccaggtacttcccctagcggtgaatcttctactgctccaggttctaccagctctaccgcagaatctccgggtccaggtagctctaccccttctggtgcaaccggctctccaggtgcatccccgggtaccagctctaccggttctccaggtactccgggtagcggtaccgcttcttcctctccaggtagccctgctggctctccgacttctactgaggaaggtagcccggctggttctccgacttctactgaggaaggtacttctaccgaaccttccgaaggtagcgctcca

SEQ ID NO: 122 - DNA, 2592 bp, Artificial Sequence
  Description of Artificial Sequence: Synthetic polynucleotide
ggtacttccaccgaaccatccgaaccaggtagcgcaggtacttccaccgaaccatccgaacctggcagcgcaggtagcgaaccggcaacctctggtactgaaccatcaggtagcggcgcatccgagcctacctctactgaaccaggtagcgaaccggctacctccggtactgagccatcaggtagcgaaccggcaacttccggtactgaaccatcaggtagcgaaccggcaacttccggcactgaaccatcaggtagcggtgcatctgagccgacctctactgaaccaggtacttctactgaaccatctgagccgggcagcgcaggtagcgaaccagctacttctggcactgaaccatcaggtacttctactgaaccatccgaaccaggtagcgcaggtagcgaacctgctacctctggtactgagccatcaggtagcgaaccggctacctctggtactgaaccatcaggtacttctaccgaaccatccgagcctggtagcgcaggtacttctaccgaaccatccgagccaggcagcgcaggtagcgaaccggcaacctctggcactgagccatcaggtagcgaaccagcaacttctggtactgaaccatcaggtactagcgagccatctacttccgaaccaggtgcaggtagcggcgcatccgaacctacttccactgaaccaggtactagcgagccatccacctctgaaccaggtgcaggtagcgaaccggcaacttccggcactgaaccatcaggtagcgaaccggctacctctggtactgaaccatcaggtacttctaccgaaccatccgagcctggtagcgcaggtacttctaccgaaccatccgagccaggcagcgcaggtagcggtgcatccgagccgacctctactgaaccaggtagcgaaccagcaacttctggcactgagccatcaggtagcgaaccagctacctctggtactgaaccatcaggtagcgaaccggctacttccggcactgaaccatcaggtagcgaaccagcaacctccggtactgaaccatcaggtacttccactgaaccatccgaaccgggtagcgcaggtagcgaaccggcaacttccggcactgaaccatcaggtagcggtgcatctgagccgacctctactgaaccaggtacttctactgaaccatctgagccgggcagcgcaggtagcgaacctgcaacctccggcactgagccatcaggtagcggcgcatctgaaccaacctctactgaaccaggtacttccaccgaaccatctgagccaggcagcgcaggtagcggcgcatctgaaccaacctctactgaaccaggtagcgaaccagcaacttctggtactgaaccatcaggtagcggcgcatctgagcctacttccactgaaccaggtagcgaaccggcaacttccggcactgaaccatcaggtagcggtgcatctgagccgacctctactgaaccaggtacttctactgaaccatctgagccgggcagcgcaggtagcgaaccggcaacttccggcactgaaccatcaggtagcggtgcatctgagccgacctctactgaaccaggtacttctactgaaccatctgagccgggcagcgcaggtagcgaaccagctacttctggcactgaaccatcaggtacttctactgaaccatccgaaccaggtagcgcaggtagcgaacctgctacctctggtactgagccatcaggtacttctactgaaccatccgagccgggtagcgcaggtacttccactgaaccatctgaacctggtagcgcaggtacttccactgaaccatccgaaccaggtagcgcaggtacttctactgaaccatccgagccgggtagcgcaggtacttccactgaaccatctgaacctggtagcgcaggtacttccactgaaccatccgaaccaggtagcgcaggtactagcgaaccatccacctccgaaccaggcgcaggtagcggtgcatctgaaccgacttctactgaaccaggtacttccactgaaccatctgagccaggtagcgcaggtacttccaccgaaccatccgaaccaggtagcgcaggtacttccaccgaaccatccgaacctggcagcgcaggtagcgaaccggcaacctctggtactgaaccatcaggtagcggtgcatccgagccgacctctactgaaccaggtagcgaaccagcaacttctggcactgagccatcaggtagcgaaccagctacctctggtactgaaccatcaggtagcgaaccggcaacctctggcactgagccatcaggtagcgaaccagcaacttctggtactgaaccatcaggtactagcgagccatctacttccgaaccaggtgcaggtagcgaacctgcaacctccggcactgagccatcaggtagcggcgcatctgaaccaacctctactgaaccaggtacttccaccgaaccatctgagccaggcagcgcaggtagcgaacctgcaacctccggcactgagccatcaggtagcggcgcatctgaaccaacctctactgaaccaggtacttccaccgaaccatctgagccaggcagcgca

SEQ ID NO: 123 - DNA, 2592 bp, Artificial Sequence
  Description of Artificial Sequence: Synthetic polynucleotide
ggtagcgaaactgctacttccggctctgagactgcaggtactagtgaatccgcaactagcgaatctggcgcaggtagcactgcaggctctgagacttccactgaagcaggtactagcgagtccgcaaccagcgaatccggcgcaggtagcgaaactgctacctctggctccgagactgcaggtagcgaaactgcaacctctggctctgaaactgcaggtacttccactgaagcaagtgaaggctccgcatcaggtacttccaccgaagcaagcgaaggctccgcatcaggtactagtgagtccgcaactagcgaatccggtgcaggtagcgaaaccgctacctctggttccgaaactgcaggtacttctaccgaggctagcgaaggttctgcatcaggtagcactgctggttccgagacttctactgaagcaggtactagcgaatctgctactagcgaatccggcgcaggtactagcgaatccgctaccagcgaatccggcgcaggtagcgaaactgcaacctctggttccgagactgcaggtactagcgagtccgctactagcgaatctggcgcaggtacttccactgaagctagtgaaggttctgcatcaggtagcgaaactgctacttctggttccgaaactgcaggtagcgaaaccgctacctctggttccgaaactgcaggtacttctaccgaggctagcgaaggttctgcatcaggtagcactgctggttccgagacttctactgaagcaggtactagcgagtccgctactagcgaatctggcgcaggtacttccactgaagctagtgaaggttctgcatcaggtagcgaaactgctacttctggttccgaaactgcaggtagcactgctggctccgagacttctaccgaagcaggtagcactgcaggttccgaaacttccactgaagcaggtagcgaaactgctacctctggctctgagactgcaggtactagcgaatctgctactagcgaatccggcgcaggtactagcgaatccgctaccagcgaatccggcgcaggtagcgaaactgcaacctctggttccgagactgcaggtactagcgaatctgctactagcgaatccggcgcaggtactagcgaatccgctaccagcgaatccggcgcaggtagcgaaactgcaacctctggttccgagactgcaggtagcgaaaccgctacctctggttccgaaactgcaggtacttctaccgaggctagcgaaggttctgcatcaggtagcactgctggttccgagacttctactgaagcaggtagcgaaactgctacttccggctctgagactgcaggtactagtgaatccgcaactagcgaatctggcgcaggtagcactgcaggctctgagacttccactgaagcaggtagcactgctggttccgaaacctctaccgaagcaggtagcactgcaggttctgaaacctccactgaagcaggtacttccactgaggctagtgaaggctctgcatcaggtagcactgctggttccgaaacctctaccgaagcaggtagcactgcaggttctgaaacctccactgaagcaggtacttccactgaggctagtgaaggctctgcatcaggtagcactgcaggttctgagacttccaccgaagcaggtagcgaaactgctacttctggttccgaaactgcaggtacttccactgaagctagtgaaggttccgcatcaggtactagtgagtccgcaaccagcgaatccggcgcaggtagcgaaaccgcaacctccggttctgaaactgcaggtactagcgaatccgcaaccagcgaatctggcgcaggtactagtgagtccgcaaccagcgaatccggcgcaggtagcgaaaccgcaacctccggttctgaaactgcaggtactagcgaatccgcaaccagcgaatctggcgcaggtagcgaaactgctacttccggctctgagactgcaggtacttccaccgaagcaagcgaaggttccgcatcaggtacttccaccgaggctagtgaaggctctgcatcaggtagcactgctggctccgagacttctaccgaagcaggtagcactgcaggttccgaaacttccactgaagcaggtagcgaaactgctacctctggctctgagactgcaggtactagcgaatctgctactagcgaatccggcgcaggtactagcgaatccgctaccagcgaatccggcgcaggtagcgaaactgcaacctctggttccgagactgcaggtagcgaaactgctacttccggctccgagactgcaggtagcgaaactgctacttctggctccgaaactgcaggtacttctactgaggctagtgaaggttccgcatcaggtactagcgagtccgcaaccagcgaatccggcgcaggtagcgaaactgctacctctggctccgagactgcaggtagcgaaactgcaacctctggctctgaaactgcaggtactagcgaatctgctactagcgaatccggcgcaggtactagcgaatccgctaccagcgaatccggcgcaggtagcgaaactgcaacctctggttccgagactgca

SEQ ID NO: 124 - DNA, 37 bp, Artificial Sequence
  Description of Artificial Sequence: Synthetic oligonucleotide
aggtgcaagcgcaagcggcgcgccaagcacgggaggt

SEQ ID NO: 125 - DNA, 37 bp, Artificial Sequence
  Description of Artificial Sequence: Synthetic oligonucleotide
aggtccagaaccaacggggccggccccaagcggaggt

SEQ ID NO: 126 - protein, 6 aa, Artificial Sequence
  Description of Artificial Sequence: Synthetic peptide
HHHHHH

SEQ ID NO: 127 - protein, 4 aa, Artificial Sequence
  Description of Artificial Sequence: Synthetic peptide
DDDK

SEQ ID NO: 128 - protein, 4 aa, Artificial Sequence
  Description of Artificial Sequence: Synthetic peptide
IDGR

SEQ ID NO: 129 - protein, 6 aa, Artificial Sequence
  Description of Artificial Sequence: Synthetic peptide
LVPRGS

SEQ ID NO: 130 - protein, 8 aa, Artificial Sequence
  Description of Artificial Sequence: Synthetic peptide
LEVLFQGP

SEQ ID NO: 131 - protein, 7 aa, Artificial Sequence
  Description of Artificial Sequence: Synthetic peptide
EQLYFQG

SEQ ID NO: 132 - protein, 7 aa, Artificial Sequence
  Description of Artificial Sequence: Synthetic peptide
ETLFQGP

SEQ ID NO: 133 - protein, 5 aa, Artificial Sequence
  Description of Artificial Sequence: Synthetic peptide
LPETG

SEQ ID NO: 134 - DNA, 147 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctcca

SEQ ID NO: 135 - DNA, 147 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctcca

SEQ ID NO: 136 - protein, 12 aa, Artificial Sequence
  Description of Artificial Sequence: Synthetic peptide
GESPGGSSGSES

SEQ ID NO: 137 - protein, 12 aa, Artificial Sequence
  Description of Artificial Sequence: Synthetic peptide
GSEGSSGPGESS

SEQ ID NO: 138 - protein, 12 aa, Artificial Sequence
  Description of Artificial Sequence: Synthetic peptide
GSSESGSSEGGP

SEQ ID NO: 139 - protein, 12 aa, Artificial Sequence
  Description of Artificial Sequence: Synthetic peptide
GSGGEPSESGSS

SEQ ID NO: 140 - DNA, 36 bp, Artificial Sequence
  Description of Artificial Sequence: Synthetic oligonucleotide
aggtgaatctccdggtggytcyagcggttcygartc

SEQ ID NO: 141 - DNA, 36 bp, Artificial Sequence
  Description of Artificial Sequence: Synthetic oligonucleotide
acctgaytcrgaaccgctrgarccacchggagattc

SEQ ID NO: 142 - DNA, 36 bp, Artificial Sequence
  Description of Artificial Sequence: Synthetic oligonucleotide
aggtagcgaaggttcttcyggtccdggygartcytc

SEQ ID NO: 143 - DNA, 36 bp, Artificial Sequence
  Description of Artificial Sequence: Synthetic oligonucleotide
acctgargaytcrcchggaccrgaagaaccttcgct

SEQ ID NO: 144 - DNA, 36 bp, Artificial Sequence
  Description of Artificial Sequence: Synthetic oligonucleotide
aggttcytcygaaagcggttcttcygarggyggtcc

SEQ ID NO: 145 - DNA, 36 bp, Artificial Sequence
  Description of Artificial Sequence: Synthetic oligonucleotide
acctggaccrccytcrgaagaaccgctttcrgarga

SEQ ID NO: 146 - DNA, 36 bp, Artificial Sequence
  Description of Artificial Sequence: Synthetic oligonucleotide
aggttcyggtggygaaccdtcygartctggtagctc

SEQ ID NO: 147 - DNA, 24 bp, Artificial Sequence
  Description of Artificial Sequence: Synthetic oligonucleotide
aggttcgtcttcactcgagggtac

SEQ ID NO: 148 - DNA, 16 bp, Artificial Sequence
  Description of Artificial Sequence: Synthetic oligonucleotide
cctcgagtgaagacga

SEQ ID NO: 149 - protein, 36 aa, Artificial Sequence
  Description of Artificial Sequence: Synthetic polypeptide
GSGGEPSESGSSGESPGGSSGSESGESPGGSSGSES

SEQ ID NO: 150 - DNA, 108 bp, Artificial Sequence
  Description of Artificial Sequence: Synthetic polynucleotide
ggttctggtggcgaaccgtccgagtctggtagctcaggtgaatctccgggtggctctagcggttccgagtcaggtgaatctcctggtggttccagcggttccgagtca

SEQ ID NO: 151 - protein, 36 aa, Artificial Sequence
  Description of Artificial Sequence: Synthetic polypeptide
GSEGSSGPGESSGESPGGSSGSESGSSESGSSEGGP

SEQ ID NO: 152 - DNA, 108 bp, Artificial Sequence
  Description of Artificial Sequence: Synthetic polynucleotide
ggtagcgaaggttcttctggtcctggcgagtcttcaggtgaatctcctggtggttccagcggttctgaatcaggttcctccgaaagcggttcttccgagggcggtcca

SEQ ID NO: 153 - protein, 36 aa, Artificial Sequence
  Description of Artificial Sequence: Synthetic polypeptide
GSSESGSSEGGPGSSESGSSEGGPGESPGGSSGSES

SEQ ID NO: 154 - DNA, 108 bp, Artificial Sequence
  Description of Artificial Sequence: Synthetic polynucleotide
ggttcctctgaaagcggttcttccgaaggtggtccaggttcctctgaaagcggttcttctgagggtggtccaggtgaatctccgggtggctccagcggttccgagtca

SEQ ID NO: 155 - protein, 36 aa, Artificial Sequence
  Description of Artificial Sequence: Synthetic polypeptide
GSGGEPSESGSSGSSESGSSEGGPGSGGEPSESGSS

SEQ ID NO: 156 - DNA, 108 bp, Artificial Sequence
  Description of Artificial Sequence: Synthetic polynucleotide
ggttccggtggcgaaccgtctgaatctggtagctcaggttcttctgaaagcggttcttccgagggtggtccaggttctggtggtgaaccttccgagtctggtagctca

SEQ ID NO: 157 - protein, 36 aa, Artificial Sequence
  Description of Artificial Sequence: Synthetic polypeptide
GSSESGSSEGGPGSEGSSGPGESSGSEGSSGPGESS

SEQ ID NO: 158 - DNA, 108 bp, Artificial Sequence
  Description of Artificial Sequence: Synthetic polynucleotide
ggttcttccgaaagcggttcttctgagggtggtccaggtagcgaaggttcttccggtccaggtgagtcttcaggtagcgaaggttcttctggtcctggtgaatcttca

SEQ ID NO: 159 - protein, 36 aa, Artificial Sequence
  Description of Artificial Sequence: Synthetic polypeptide
GSSESGSSEGGPGESPGGSSGSESGSEGSSGPGESS

SEQ ID NO: 160 - DNA, 108 bp, Artificial Sequence
  Description of Artificial Sequence: Synthetic polynucleotide
ggttcctctgaaagcggttcttccgagggtggtccaggtgaatctccaggtggttccagcggttctgagtcaggtagcgaaggttcttctggtccaggtgaatcctca

SEQ ID NO: 161 - protein, 36 aa, Artificial Sequence
  Description of Artificial Sequence: Synthetic polypeptide
GSGGEPSESGSSGSGGEPSESGSSGSEGSSGPGESS

SEQ ID NO: 162 - DNA, 108 bp, Artificial Sequence
  Description of Artificial Sequence: Synthetic polynucleotide
ggttctggtggtgaaccgtctgagtctggtagctcaggttccggtggcgaaccatccgaatctggtagctcaggtagcgaaggttcttccggtccaggtgagtcttca

SEQ ID NO: 163 - protein, 36 aa, Artificial Sequence
  Description of Artificial Sequence: Synthetic polypeptide
GSSESGSSEGGPGSEGSSGPGESSGESPGGSSGSES

SEQ ID NO: 164 - DNA, 108 bp, Artificial Sequence
  Description of Artificial Sequence: Synthetic polynucleotide
ggttcttccgaaagcggttcttccgaaggcggtccaggtagcgaaggttcttctggtccaggcgaatcttcaggtgaatctcctggtggctccagcggttctgagtca

SEQ ID NO: 165 - protein, 36 aa, Artificial Sequence
  Description of Artificial Sequence: Synthetic polypeptide
GSSESGSSEGGPGSSESGSSEGGPGSSESGSSEGGP

SEQ ID NO: 166 - DNA, 108 bp, Artificial Sequence
  Description of Artificial Sequence: Synthetic polynucleotide
ggttcctccgaaagcggttcttctgagggcggtccaggttcctccgaaagcggttcttccgagggcggtccaggttcttctgaaagcggttcttccgagggcggtcca

SEQ ID NO: 167 - protein, 36 aa, Artificial Sequence
  Description of Artificial Sequence: Synthetic polypeptide
GSGGEPSESGSSGSEGSSGPGESSGSSESGSSEGGP

SEQ ID NO: 168 - DNA, 108 bp, Artificial Sequence
  Description of Artificial Sequence: Synthetic polynucleotide
ggttccggtggcgaaccgtccgaatctggtagctcaggtagcgaaggttcttctggtccaggcgaatcttcaggttcctctgaaagcggttcttctgagggcggtcca

SEQ ID NO: 169 - protein, 36 aa, Artificial Sequence; identical to SEQ ID NO: 155
  Description of Artificial Sequence: Synthetic polypeptide

SEQ ID NO: 170 - DNA, 108 bp, Artificial Sequence
  Description of Artificial Sequence: Synthetic polynucleotide
ggttctggtggtgaaccgtccgaatctggtagctcaggttcttccgaaagcggttcttctgaaggtggtccaggttccggtggcgaaccttctgaatctggtagctca

SEQ ID NO: 171 - protein, 36 aa, Artificial Sequence
  Description of Artificial Sequence: Synthetic polypeptide
GSGGEPSESGSSGSSESGSSEGGPGESPGGSSGSES

SEQ ID NO: 172 - DNA, 108 bp, Artificial Sequence
  Description of Artificial Sequence: Synthetic polynucleotide
ggttctggtggcgaaccgtccgaatctggtagctcaggttcctccgaaagcggttcttctgaaggtggtccaggtgaatctccaggtggttctagcggttctgaatca

SEQ ID NO: 173 - protein, 36 aa, Artificial Sequence
  Description of Artificial Sequence: Synthetic polypeptide
GSGGEPSESGSSGESPGGSSGSESGSEGSSGPGESS

SEQ ID NO: 174 - DNA, 108 bp, Artificial Sequence
  Description of Artificial Sequence: Synthetic polynucleotide
ggttctggtggcgaaccgtctgagtctggtagctcaggtgaatctcctggtggctccagcggttctgaatcaggtagcgaaggttcttctggtcctggtgaatcttca

SEQ ID NO: 175 - protein, 36 aa, Artificial Sequence
  Description of Artificial Sequence: Synthetic polypeptide
GSGGEPSESGSSGESPGGSSGSESGSGGEPSESGSS

SEQ ID NO: 176 - DNA, 108 bp, Artificial Sequence
  Description of Artificial Sequence: Synthetic polynucleotide
ggttccggtggcgaaccttccgaatctggtagctcaggtgaatctccgggtggttctagcggttctgagtcaggttctggtggtgaaccttccgagtctggtagctca

SEQ ID NO: 177 - protein, 36 aa, Artificial Sequence; identical to SEQ ID NO: 165
  Description of Artificial Sequence: Synthetic polypeptide

SEQ ID NO: 178 - DNA, 108 bp, Artificial Sequence
  Description of Artificial Sequence: Synthetic polynucleotide
ggttcctctgaaagcggttcttctgagggcggtccaggttcttccgaaagcggttcttccgagggcggtccaggttcttccgaaagcggttcttctgaaggcggtcca

SEQ ID NO: 179 - protein, 36 aa, Artificial Sequence
  Description of Artificial Sequence: Synthetic polypeptide
GESPGGSSGSESGSEGSSGPGESSGSEGSSGPGESS

SEQ ID NO: 180 - DNA, 108 bp, Artificial Sequence
  Description of Artificial Sequence: Synthetic polynucleotide
ggtgaatctccgggtggctccagcggttctgagtcaggtagcgaaggttcttccggtccgggtgagtcctcaggtagcgaaggttcttccggtcctggtgagtcttca

SEQ ID NO: 181 - protein, 36 aa, Artificial Sequence
  Description of Artificial Sequence: Synthetic polypeptide
GSGGEPSESGSSGSGGEPSESGSSGSSESGSSEGGP

SEQ ID NO: 182 - DNA, 108 bp, Artificial Sequence
  Description of Artificial Sequence: Synthetic polynucleotide
ggttctggtggcgaaccttccgaatctggtagctcaggttccggtggtgaaccttctgaatctggtagctcaggttcttctgaaagcggttcttccgagggcggtcca

SEQ ID NO: 183 - protein, 36 aa, Artificial Sequence
  Description of Artificial Sequence: Synthetic polypeptide
GSGGEPSESGSSGSGGEPSESGSSGSGGEPSESGSS

SEQ ID NO: 184 - DNA, 108 bp, Artificial Sequence
  Description of Artificial Sequence: Synthetic polynucleotide
ggttccggtggtgaaccttctgaatctggtagctcaggttccggtggcgaaccatccgagtctggtagctcaggttccggtggtgaaccatccgagtctggtagctca

SEQ ID NO: 185 - protein, 36 aa, Artificial Sequence
  Description of Artificial Sequence: Synthetic polypeptide
GSGGEPSESGSSGSSESGSSEGGPGSEGSSGPGESS

SEQ ID NO: 186 - DNA, 108 bp, Artificial Sequence
  Description of Artificial Sequence: Synthetic polynucleotide
ggttccggtggcgaaccttctgaatctggtagctcaggttcctccgaaagcggttcttctgagggcggtccaggtagcgaaggttcttctggtccgggcgagtcttca

SEQ ID NO: 187 - protein, 36 aa, Artificial Sequence
  Description of Artificial Sequence: Synthetic polypeptide
GSGGEPSESGSSGSEGSSGPGESSGSGGEPSESGSS

SEQ ID NO: 188 - DNA, 108 bp, Artificial Sequence
  Description of Artificial Sequence: Synthetic polynucleotide
ggttccggtggtgaaccgtccgagtctggtagctcaggtagcgaaggttcttctggtccgggtgagtcttcaggttctggtggcgaaccgtccgaatctggtagctca

SEQ ID NO: 189 - protein, 36 aa, Artificial Sequence; identical to SEQ ID NO: 175
  Description of Artificial Sequence: Synthetic polypeptide

SEQ ID NO: 190 - DNA, 108 bp, Artificial Sequence
  Description of Artificial Sequence: Synthetic polynucleotide
ggttctggtggcgaaccgtccgaatctggtagctcaggtgaatctcctggtggttccagcggttccgagtcaggttctggtggcgaaccttccgaatctggtagctca

SEQ ID NO: 191 - protein, 36 aa, Artificial Sequence
  Description of Artificial Sequence: Synthetic polypeptide
GSSESGSSEGGPGSGGEPSESGSSGSSESGSSEGGP

SEQ ID NO: 192 - DNA, 108 bp, Artificial Sequence
  Description of Artificial Sequence: Synthetic polynucleotide
ggttcttccgaaagcggttcttccgagggcggtccaggttccggtggtgaaccatctgaatctggtagctcaggttcttctgaaagcggttcttctgaaggtggtcca

SEQ ID NO: 193 - protein, 36 aa, Artificial Sequence
  Description of Artificial Sequence: Synthetic polypeptide
GSEGSSGPGESSGESPGGSSGSESGSEGSSGPGESS

SEQ ID NO: 194 - DNA, 108 bp, Artificial Sequence
  Description of Artificial Sequence: Synthetic polynucleotide
ggtagcgaaggttcttccggtcctggtgagtcttcaggtgaatctccaggtggctctagcggttccgagtcaggtagcgaaggttcttctggtcctggcgagtcctca

SEQ ID NO: 195 - protein, 36 aa, Artificial Sequence; identical to SEQ ID NO: 165
  Description of Artificial Sequence: Synthetic polypeptide

SEQ ID NO: 196 - DNA, 108 bp, Artificial Sequence
  Description of Artificial Sequence: Synthetic polynucleotide
ggttcctctgaaagcggttcttccgaaggcggtccaggttcttccgaaagcggttcttctgagggcggtccaggttcctccgaaagcggttcttctgagggtggtcca

SEQ ID NO: 197 - protein, 36 aa, Artificial Sequence; identical to SEQ ID NO: 149
  Description of Artificial Sequence: Synthetic polypeptide

SEQ ID NO: 198 - DNA, 108 bp, Artificial Sequence
  Description of Artificial Sequence: Synthetic polynucleotide
ggttctggtggcgaaccttccgagtctggtagctcaggtgaatctccgggtggttctagcggttccgagtcaggtgaatctccgggtggttccagcggttctgagtca

SEQ ID NO: 199 - protein, 36 aa, Artificial Sequence
  Description of Artificial Sequence: Synthetic polypeptide
GSGGEPSESGSSGSEGSSGPGESSGESPGGSSGSES

SEQ ID NO: 200 - DNA, 108 bp, Artificial Sequence
  Description of Artificial Sequence: Synthetic polynucleotide
ggttctggtggcgaaccatctgagtctggtagctcaggtagcgaaggttcttccggtccaggcgagtcttcaggtgaatctcctggtggctccagcggttctgagtca

SEQ ID NO: 201 - protein, 36 aa, Artificial Sequence
  Description of Artificial Sequence: Synthetic polypeptide
GESPGGSSGSESGESPGGSSGSESGESPGGSSGSES

SEQ ID NO: 202 - DNA, 108 bp, Artificial Sequence
  Description of Artificial Sequence: Synthetic polynucleotide
ggtgaatctcctggtggttccagcggttccgagtcaggtgaatctccaggtggctctagcggttccgagtcaggtgaatctcctggtggttctagcggttctgaatca

SEQ ID NO: 203 - protein, 36 aa, Artificial Sequence
  Description of Artificial Sequence: Synthetic polypeptide
GSEGSSGPGESSGSEGSSGPGESSGSGGEPSESGSS

SEQ ID NO: 204 - DNA, 108 bp, Artificial Sequence
  Description of Artificial Sequence: Synthetic polynucleotide
ggtagcgaaggttcttccggtccaggtgaatcttcaggtagcgaaggttcttctggtcctggtgaatcctcaggttccggtggcgaaccatctgaatctggtagctca

SEQ ID NO: 205 - protein, 36 aa, Artificial Sequence; identical to SEQ ID NO: 199
  Description of Artificial Sequence: Synthetic polypeptide

SEQ ID NO: 206 - DNA, 108 bp, Artificial Sequence
  Description of Artificial Sequence: Synthetic polynucleotide
ggttctggtggcgaaccatccgaatctggtagctcaggtagcgaaggttcttctggtcctggcgaatcttcaggtgaatctccaggtggctctagcggttccgaatca

SEQ ID NO: 207 - protein, 36 aa, Artificial Sequence; identical to SEQ ID NO: 155
  Description of Artificial Sequence: Synthetic polypeptide

SEQ ID NO: 208 - DNA, 108 bp, Artificial Sequence
  Description of Artificial Sequence: Synthetic polynucleotide
ggttccggtggtgaaccgtccgaatctggtagctcaggttcctctgaaagcggttcttccgagggtggtccaggttccggtggtgaaccttctgagtctggtagctca

SEQ ID NO: 209 - protein, 36 aa, Artificial Sequence
  Description of Artificial Sequence: Synthetic polypeptide
GSSESGSSEGGPGSGGEPSESGSSGSEGSSGPGESS

SEQ ID NO: 210 - DNA, 108 bp, Artificial Sequence
  Description of Artificial Sequence: Synthetic polynucleotide
ggttcctctgaaagcggttcttctgagggcggtccaggttctggtggcgaaccatctgaatctggtagctcaggtagcgaaggttcttccggtccgggtgaatcttca

SEQ ID NO: 211 - protein, 36 aa, Artificial Sequence
  Description of Artificial Sequence: Synthetic polypeptide
GSGGEPSESGSSGSEGSSGPGESSGSEGSSGPGESS

SEQ ID NO: 212 - DNA, 108 bp, Artificial Sequence
  Description of Artificial Sequence: Synthetic polynucleotide
ggttctggtggtgaaccgtccgaatctggtagctcaggtagcgaaggttcttctggtcctggcgagtcttcaggtagcgaaggttcttctggtcctggtgaatcttca

SEQ ID NO: 213 - protein, 36 aa, Artificial Sequence; identical to SEQ ID NO: 155
  Description of Artificial Sequence: Synthetic polypeptide

SEQ ID NO: 214 - DNA, 108 bp, Artificial Sequence
  Description of Artificial Sequence: Synthetic polynucleotide
ggttctggtggcgaaccatccgagtctggtagctcaggttcttccgaaagcggttcttccgaaggcggtccaggttctggtggtgaaccgtccgaatctggtagctca

SEQ ID NO: 215 - protein, 36 aa, Artificial Sequence; identical to SEQ ID NO: 149
  Description of Artificial Sequence: Synthetic polypeptide

SEQ ID NO: 216 - DNA, 108 bp, Artificial Sequence
  Description of Artificial Sequence: Synthetic polynucleotide
ggttccggtggcgaaccttccgaatctggtagctcaggtgaatctccgggtggttctagcggttccgaatcaggtgaatctccaggtggttctagcggttccgaatca

SEQ ID NO: 217 - protein, 36 aa, Artificial Sequence
  Description of Artificial Sequence: Synthetic polypeptide
GSGGEPSESGSSGSGGEPSESGSSGESPGGSSGSES

SEQ ID NO: 218 - DNA, 108 bp, Artificial Sequence
  Description of Artificial Sequence: Synthetic polynucleotide
ggttccggtggtgaaccatctgagtctggtagctcaggttccggtggcgaaccgtccgagtctggtagctcaggtgaatctccgggtggttccagcggttccgaatca

SEQ ID NO: 219 - protein, 36 aa, Artificial Sequence
  Description of Artificial Sequence: Synthetic polypeptide
GSEGSSGPGESSGSSESGSSEGGPGSEGSSGPGESS

SEQ ID NO: 220 - DNA, 108 bp, Artificial Sequence
  Description of Artificial Sequence: Synthetic polynucleotide
ggtagcgaaggttcttctggtccgggcgaatcctcaggttcctccgaaagcggttcttccgaaggtggtccaggtagcgaaggttcttccggtcctggtgaatcttca

SEQ ID NO: 221 - protein, 36 aa, Artificial Sequence
  Description of Artificial Sequence: Synthetic polypeptide
GSSESGSSEGGPGESPGGSSGSESGESPGGSSGSES

SEQ ID NO: 222 - DNA, 108 bp, Artificial Sequence
  Description of Artificial Sequence: Synthetic polynucleotide
ggttcctctgaaagcggttcttctgaaggcggtccaggtgaatctccgggtggctccagcggttctgaatcaggtgaatctcctggtggctccagcggttccgagtca

SEQ ID NO: 223 - protein, 36 aa, Artificial Sequence; identical to SEQ ID NO: 203
  Description of Artificial Sequence: Synthetic polypeptide

SEQ ID NO: 224 - DNA, 108 bp, Artificial Sequence
  Description of Artificial Sequence: Synthetic polynucleotide
ggtagcgaaggttcttctggtccaggcgagtcttcaggtagcgaaggttcttccggtcctggcgagtcttcaggttccggtggcgaaccgtccgaatctggtagctca

SEQ ID NO: 225 - protein, 12 aa, Artificial Sequence
  Description of Artificial Sequence: Synthetic peptide
GSPAGSPTSTEE

SEQ ID NO: 226 - protein, 12 aa, Artificial Sequence
  Description of Artificial Sequence: Synthetic peptide
GSEPATSGSETP

SEQ ID NO: 227 - protein, 12 aa, Artificial Sequence
  Description of Artificial Sequence: Synthetic peptide
GTSESATPESGP

SEQ ID NO: 228 - protein, 12 aa, Artificial Sequence
  Description of Artificial Sequence: Synthetic peptide
GTSTEPSEGSAP

SEQ ID NO: 229 - DNA, 36 bp, Artificial Sequence
  Description of Artificial Sequence: Synthetic oligonucleotide
aggtagcccdgcwggytctccdacytcyacygarga

SEQ ID NO: 230 - DNA, 36 bp, Artificial Sequence
  Description of Artificial Sequence: Synthetic oligonucleotide
accttcytcrgtrgargthggagarccwgchgggct

SEQ ID NO: 231 - DNA, 36 bp, Artificial Sequence
  Description of Artificial Sequence: Synthetic oligonucleotide
aggtagcgaacckgcwacytcyggytctgaracycc

SEQ ID NO: 232 - DNA, 36 bp, Artificial Sequence
  Description of Artificial Sequence: Synthetic oligonucleotide
acctggrgtytcagarccrgargtwgcmggttcgct

SEQ ID NO: 233 - DNA, 36 bp, Artificial Sequence
  Description of Artificial Sequence: Synthetic oligonucleotide
aggtacytctgaaagcgcwacycckgartcyggycc

SEQ ID NO: 234 - DNA, 36 bp, Artificial Sequence
  Description of Artificial Sequence: Synthetic oligonucleotide
acctggrccrgaytcmggrgtwgcgctttcagargt

SEQ ID NO: 235 - DNA, 36 bp, Artificial Sequence
  Description of Artificial Sequence: Synthetic oligonucleotide
aggtacytctacygaaccktcygarggyagcgcwcc

SEQ ID NO: 236 - DNA, 36 bp, Artificial Sequence
  Description of Artificial Sequence: Synthetic oligonucleotide
acctggwgcgctrccytcrgamggttcrgtagargt

SEQ ID NO: 237 - DNA, 24 bp, Artificial Sequence
  Description of Artificial Sequence: Synthetic oligonucleotide
aggttcgtcttcactcgagggtac

SEQ ID NO: 238 - DNA, 16 bp, Artificial Sequence
  Description of Artificial Sequence: Synthetic oligonucleotide
cctcgagtgaagacga

SEQ ID NO: 239 - protein, 36 aa, Artificial Sequence
  Description of Artificial Sequence: Synthetic polypeptide
GSPAGSPTSTEEGTSESATPESGPGTSTEPSEGSAP

SEQ ID NO: 240 - DNA, 108 bp, Artificial Sequence
  Description of Artificial Sequence: Synthetic polynucleotide
ggtagcccggcaggctctccgacctctactgaggaaggtacttctgaaagcgcaaccccggagtccggcccaggtacctctaccgaaccgtctgagggcagcgcacca

SEQ ID NO: 241 - protein, 36 aa, Artificial Sequence
  Description of Artificial Sequence: Synthetic polypeptide
GTSTEPSEGSAPGTSTEPSEGSAPGTSTEPSEGSAP

SEQ ID NO: 242 - DNA, 108 bp, Artificial Sequence
  Description of Artificial Sequence: Synthetic polynucleotide
ggtacttctaccgaaccgtccgaaggcagcgctccaggtacctctactgaaccttccgagggcagcgctccaggtacctctaccgaaccttctgaaggtagcgcacca

SEQ ID NO: 243 - protein, 36 aa, Artificial Sequence
  Description of Artificial Sequence: Synthetic polypeptide
GTSTEPSEGSAPGTSESATPESGPGTSESATPESGP

SEQ ID NO: 244 - DNA, 108 bp, Artificial Sequence
  Description of Artificial Sequence: Synthetic polynucleotide
ggtacctctaccgaaccgtctgaaggtagcgcaccaggtacctctgaaagcgcaactcctgagtccggtccaggtacttctgaaagcgcaaccccggagtctggccca

SEQ ID NO: 245 - protein, 36 aa, Artificial Sequence; identical to SEQ ID NO: 243
  Description of Artificial Sequence: Synthetic polypeptide

SEQ ID NO: 246 - DNA, 108 bp, Artificial Sequence
  Description of Artificial Sequence: Synthetic polynucleotide
ggtacttctactgaaccgtctgaaggtagcgcaccaggtacttctgaaagcgcaaccccggaatccggcccaggtacctctgaaagcgcaaccccggagtccggccca

SEQ ID NO: 247 - protein, 36 aa, Artificial Sequence
  Description of Artificial Sequence: Synthetic polypeptide
GSEPATSGSETPGTSESATPESGPGSPAGSPTSTEE

SEQ ID NO: 248 - DNA, 108 bp, Artificial Sequence
  Description of Artificial Sequence: Synthetic polynucleotide
ggtagcgaaccggcaacctccggctctgaaaccccaggtacctctgaaagcgctactcctgaatccggcccaggtagcccggcaggttctccgacttccactgaggaa

SEQ ID NO: 249 - protein, 36 aa, Artificial Sequence
  Description of Artificial Sequence: Synthetic polypeptide
GTSESATPESGPGSEPATSGSETPGTSTEPSEGSAP

SEQ ID NO: 250 - DNA, 108 bp, Artificial Sequence
  Description of Artificial Sequence: Synthetic polynucleotide
ggtacttctgaaagcgcaacccctgaatccggtccaggtagcgaaccggctacttctggctctgagactccaggtacttctaccgaaccgtccgaaggtagcgcacca

SEQ ID NO: 251 - protein, 36 aa, Artificial Sequence
  Description of Artificial Sequence: Synthetic polypeptide
GSPAGSPTSTEEGSPAGSPTSTEEGSEPATSGSETP

SEQ ID NO: 252 - DNA, 108 bp, Artificial Sequence
  Description of Artificial Sequence: Synthetic polynucleotide
ggtagcccggctggctctccaacctccactgaggaaggtagcccggctggctctccaacctccactgaagaaggtagcgaaccggctacctccggctctgaaactcca

SEQ ID NO: 253 - protein, 36 aa, Artificial Sequence; identical to SEQ ID NO: 239
  Description of Artificial Sequence: Synthetic polypeptide

SEQ ID NO: 254 - DNA, 108 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctcca

SEQ ID NO: 255 - protein, 36 aa, Artificial Sequence
  Description of Artificial Sequence: Synthetic polypeptide
GSPAGSPTSTEEGSPAGSPTSTEEGTSTEPSEGSAP

SEQ ID NO: 256 - DNA, 108 bp, Artificial Sequence
  Description of Artificial Sequence: Synthetic polynucleotide
ggtagccctgctggctctccgacttctactgaggaaggtagcccggctggttctccgacttctactgaggaaggtacttctaccgaaccttccgaaggtagcgctcca

SEQ ID NO: 257 - protein, 36 aa, Artificial Sequence
  Description of Artificial Sequence: Synthetic polypeptide
GTSESATPESGPGTSTEPSEGSAPGTSTEPSEGSAP

SEQ ID NO: 258 - DNA, 108 bp, Artificial Sequence
  Description of Artificial Sequence: Synthetic polynucleotide
ggtacttctgaaagcgctactccggagtccggtccaggtacctctaccgaaccgtccgaaggcagcgctccaggtacttctactgaaccttctgagggtagcgctcca

SEQ ID NO: 259 - protein, 36 aa, Artificial Sequence
  Description of Artificial Sequence: Synthetic polypeptide
GTSTEPSEGSAPGSPAGSPTSTEEGTSTEPSEGSAP

SEQ ID NO: 260 - DNA, 108 bp, Artificial Sequence
  Description of Artificial Sequence: Synthetic polynucleotide
ggtacctctaccgaaccttccgaaggtagcgctccaggtagcccggcaggttctcctacttccactgaggaaggtacttctaccgaaccttctgagggtagcgcacca

SEQ ID NO: 261 - protein, 36 aa, Artificial Sequence
  Description of Artificial Sequence: Synthetic polypeptide
GSEPATSGSETPGSPAGSPTSTEEGTSESATPESGP

SEQ ID NO: 262 - DNA, 108 bp, Artificial Sequence
  Description of Artificial Sequence: Synthetic polynucleotide
ggtagcgaaccggctacttccggctctgagactccaggtagccctgctggctctccgacctctaccgaagaaggtacctctgaaagcgctacccctgagtctggccca

SEQ ID NO: 263 - protein, 36 aa, Artificial Sequence; identical to SEQ ID NO: 243
  Description of Artificial Sequence: Synthetic polypeptide

SEQ ID NO: 264 - DNA, 108 bp, Artificial Sequence
  Description of Artificial Sequence: Synthetic polynucleotide
ggtacttctaccgaaccttccgagggcagcgcaccaggtacttctgaaagcgctacccctgagtccggcccaggtacttctgaaagcgctactcctgaatccggtcca

SEQ ID NO: 265 - protein, 36 aa, Artificial Sequence
  Description of Artificial Sequence: Synthetic polypeptide
GTSTEPSEGSAPGSEPATSGSETPGSPAGSPTSTEE

SEQ ID NO: 266 - DNA, 108 bp, Artificial Sequence
  Description of Artificial Sequence: Synthetic polynucleotide
ggtacttctactgaaccgtctgaaggcagcgcaccaggtagcgaaccggctacttccggttctgaaaccccaggtagcccagcaggttctccaacttctactgaagaa

SEQ ID NO: 267 - protein, 36 aa, Artificial Sequence
  Description of Artificial Sequence: Synthetic polypeptide
GSPAGSPTSTEEGTSESATPESGPGSEPATSGSETP

SEQ ID NO: 268 - DNA, 108 bp, Artificial Sequence
  Description of Artificial Sequence: Synthetic polynucleotide
ggtagccctgctggctctccaacctccaccgaagaaggtacctctgaaagcgcaacccctgaatccggcccaggtagcgaaccggcaacctccggttctgaaacccca

SEQ ID NO: 269 - protein, 36 aa, Artificial Sequence
  Description of Artificial Sequence: Synthetic polypeptide
GTSESATPESGPGSPAGSPTSTEEGSPAGSPTSTEE

SEQ ID NO: 270 - DNA, 108 bp, Artificial Sequence
  Description of Artificial Sequence: Synthetic polynucleotide
ggtacttctgaaagcgctactcctgagtccggcccaggtagcccggctggctctccgacttccaccgaggaaggtagcccggctggctctccaacttctactgaagaa

SEQ ID NO: 271 - protein, 36 aa, Artificial Sequence
  Description of Artificial Sequence: Synthetic polypeptide
GTSTEPSEGSAPGTSESATPESGPGTSTEPSEGSAP

SEQ ID NO: 272 - DNA, 108 bp, Artificial Sequence
  Description of Artificial Sequence: Synthetic polynucleotide
ggtacctctactgaaccttctgagggcagcgctccaggtacttctgaaagcgctaccccggagtccggtccaggtacttctactgaaccgtccgaaggtagcgcacca

SEQ ID NO: 273 - protein, 36 aa, Artificial Sequence
  Description of Artificial Sequence: Synthetic polypeptide
GSPAGSPTSTEEGTSTEPSEGSAPGSEPATSGSETP

SEQ ID NO: 274 - DNA, 108 bp, Artificial Sequence
  Description of Artificial Sequence: Synthetic polynucleotide
ggtagcccggcaggctctccgacttccaccgaggaaggtacctctactgaaccttctgagggtagcgctccaggtagcgaaccggcaacctctggctctgaaacccca

SEQ ID NO: 275 - protein, 36 aa, Artificial Sequence
  Description of Artificial Sequence: Synthetic polypeptide
GSPAGSPTSTEEGTSTEPSEGSAPGTSTEPSEGSAP

SEQ ID NO: 276 - DNA, 108 bp, Artificial Sequence
  Description of Artificial Sequence: Synthetic polynucleotide
ggtagcccagcaggctctccgacttccactgaggaaggtacttctactgaaccttccgaaggcagcgcaccaggtacctctactgaaccttctgagggcagcgctcca

SEQ ID NO: 277 - protein, 36 aa, Artificial Sequence; identical to SEQ ID NO: 247
  Description of Artificial Sequence: Synthetic polypeptide

SEQ ID NO: 278 - DNA, 108 bp, Artificial Sequence
  Description of Artificial Sequence: Synthetic polynucleotide
ggtagcgaacctgctacctccggttctgaaaccccaggtacctctgaaagcgcaactccggagtctggtccaggtagccctgcaggttctcctacctccactgaggaa

SEQ ID NO: 279 - protein, 36 aa, Artificial Sequence; identical to SEQ ID NO: 257
  Description of Artificial Sequence: Synthetic polypeptide

SEQ ID NO: 280 - DNA, 108 bp, Artificial Sequence
  Description of Artificial Sequence: Synthetic polynucleotide
ggtacctctgaaagcgctactccggagtctggcccaggtacctctactgaaccgtctgagggtagcgctccaggtacttctactgaaccgtccgaaggtagcgcacca

SEQ ID NO: 281 - protein, 36 aa, Artificial Sequence; identical to SEQ ID NO: 275
  Description of Artificial Sequence: Synthetic polypeptide

SEQ ID NO: 282 - DNA, 108 bp, Artificial Sequence
  Description of Artificial Sequence: Synthetic polynucleotide
ggtagcccggctggttctccgacttccaccgaggaaggtacctctactgaaccttctgagggtagcgctccaggtacctctactgaaccttccgaaggcagcgctcca

SEQ ID NO: 283 - protein, 36 aa, Artificial Sequence; identical to SEQ ID NO: 241
  Description of Artificial Sequence: Synthetic polypeptide

SEQ ID NO: 284 - DNA, 108 bp, Artificial Sequence
  Description of Artificial Sequence: Synthetic polynucleotide
ggtacttctaccgaaccgtccgagggcagcgctccaggtacttctactgaaccttctgaaggcagcgctccaggtacttctactgaaccttccgaaggtagcgcacca

SEQ ID NO: 285 - protein, 36 aa, Artificial Sequence
  Description of Artificial Sequence: Synthetic polypeptide
GSEPATSGSETPGTSESATPESGPGTSTEPSEGSAP

SEQ ID NO: 286 - DNA, 108 bp, Artificial Sequence
  Description of Artificial Sequence: Synthetic polynucleotide
ggtagcgaacctgcaacctctggctctgaaaccccaggtacctctgaaagcgctactcctgaatctggcccaggtacttctactgaaccgtccgagggcagcgcacca

SEQ ID NO: 287 - protein, 36 aa, Artificial Sequence; identical to SEQ ID NO: 259
  Description of Artificial Sequence: Synthetic polypeptide

SEQ ID NO: 288 - DNA, 108 bp, Artificial Sequence
  Description of Artificial Sequence: Synthetic polynucleotide
ggtacttctaccgaaccgtccgagggtagcgcaccaggtagcccagcaggttctcctacctccaccgaggaaggtacttctaccgaaccgtccgagggtagcgcacca

SEQ ID NO: 289 - protein, 36 aa, Artificial Sequence
  Description of Artificial Sequence: Synthetic polypeptide
GSEPATSGSETPGTSESATPESGPGSEPATSGSETP

SEQ ID NO: 290 - DNA, 108 bp, Artificial Sequence
  Description of Artificial Sequence: Synthetic polynucleotide
ggtagcgaaccggcaacctccggctctgaaactccaggtacttctgaaagcgctactccggaatccggcccaggtagcgaaccggctacttccggctctgaaacccca

SEQ ID NO: 291 - protein, 36 aa, Artificial Sequence; identical to SEQ ID NO: 289
  Description of Artificial Sequence: Synthetic polypeptide

SEQ ID NO: 292 - DNA, 108 bp, Artificial Sequence
  Description of Artificial Sequence: Synthetic polynucleotide
ggtagcgaaccggcaacttccggctctgaaaccccaggtacttctgaaagcgctactcctgagtctggcccaggtagcgaacctgctacctctggctctgaaacccca

SEQ ID NO: 293 - protein, 36 aa, Artificial Sequence
  Description of Artificial Sequence: Synthetic polypeptide
GSEPATSGSETPGSEPATSGSETPGTSTEPSEGSAP

SEQ ID NO: 294 - DNA, 108 bp, Artificial Sequence
  Description of Artificial Sequence: Synthetic polynucleotide
ggtagcgaaccggcaacctctggctctgaaactccaggtagcgaacctgcaacctccggctctgaaaccccaggtacttctactgaaccttctgagggcagcgcacca

SEQ ID NO: 295 - protein, 36 aa, Artificial Sequence
  Description of Artificial Sequence: Synthetic polypeptide
GTSESATPESGPGSEPATSGSETPGSEPATSGSETP

SEQ ID NO: 296 - DNA, 108 bp, Artificial Sequence
  Description of Artificial Sequence: Synthetic polynucleotide
ggtacttctgaaagcgctaccccggaatctggcccaggtagcgaaccggctacttctggttctgaaaccccaggtagcgaaccggctacctccggttctgaaactcca

SEQ ID NO: 297 - protein, 36 aa, Artificial Sequence
  Description of Artificial Sequence: Synthetic polypeptide
GTSTEPSEGSAPGTSTEPSEGSAPGTSESATPESGP

SEQ ID NO: 298 - DNA, 108 bp, Artificial Sequence
  Description of Artificial Sequence: Synthetic polynucleotide
ggtacctctactgaaccttccgaaggcagcgctccaggtacctctaccgaaccgtccgagggcagcgcaccaggtacttctgaaagcgcaacccctgaatccggtcca

SEQ ID NO: 299 - protein, 36 aa, Artificial Sequence
  Description of Artificial Sequence: Synthetic polypeptide
GSEPATSGSETPGTSESATPESGPGTSESATPESGP

SEQ ID NO: 300 - DNA, 108 bp, Artificial Sequence
  Description of Artificial Sequence: Synthetic polynucleotide
ggtagcgaaccggcaacctctggctctgaaaccccaggtacctctgaaagcgctactccggaatctggtccaggtacttctgaaagcgctactccggaatccggtcca

SEQ ID NO: 301 - protein, 36 aa, Artificial Sequence; identical to SEQ ID NO: 293
  Description of Artificial Sequence: Synthetic polypeptide

SEQ ID NO: 302 - DNA, 108 bp, Artificial Sequence
  Description of Artificial Sequence: Synthetic polynucleotide
ggtagcgaacctgctacctccggctctgaaactccaggtagcgaaccggctacttccggttctgaaactccaggtacctctaccgaaccttccgaaggcagcgcacca

SEQ ID NO: 303 - protein, 36 aa, Artificial Sequence
  Description of Artificial Sequence: Synthetic polypeptide
GSEPATSGSETPGTSTEPSEGSAPGSEPATSGSETP

SEQ ID NO: 304 - DNA, 108 bp, Artificial Sequence
  Description of Artificial Sequence: Synthetic polynucleotide
ggtagcgaacctgctacttctggttctgaaactccaggtacttctaccgaaccgtccgagggtagcgctccaggtagcgaacctgctacttctggttctgaaactcca

SEQ ID NO: 305 - protein, 36 aa, Artificial Sequence
  Description of Artificial Sequence: Synthetic polypeptide
GTSTEPSEGSAPGTSTEPSEGSAPGSEPATSGSETP

SEQ ID NO: 306 - DNA, 108 bp, Artificial Sequence
  Description of Artificial Sequence: Synthetic polynucleotide
ggtacctctaccgaaccgtccgagggtagcgcaccaggtacctctactgaaccgtctgagggtagcgctccaggtagcgaaccggcaacctccggttctgaaactcca

SEQ ID NO: 307 - protein, 36 aa, Artificial Sequence; identical to SEQ ID NO: 265
  Description of Artificial Sequence: Synthetic polypeptide

SEQ ID NO: 308 - DNA, 108 bp, Artificial Sequence
  Description of Artificial Sequence: Synthetic polynucleotide
ggtacttctactgaaccttccgaaggtagcgctccaggtagcgaacctgctacttctggttctgaaaccccaggtagcccggctggctctccgacctccaccgaggaa

SEQ ID NO: 309 - protein, 36 aa, Artificial Sequence; identical to SEQ ID NO: 261
  Description of Artificial Sequence: Synthetic polypeptide

SEQ ID NO: 310 - DNA, 108 bp, Artificial Sequence
  Description of Artificial Sequence: Synthetic polynucleotide
ggtagcgaaccggctacttccggctctgagactccaggtagcccagctggttctccaacctctactgaggaaggtacttctgaaagcgctacccctgaatctggtcca

SEQ ID NO: 311 - protein, 36 aa, Artificial Sequence
  Description of Artificial Sequence: Synthetic polypeptide
GTSESATPESGPGSEPATSGSETPGTSESATPESGP

SEQ ID NO: 312 - DNA, 108 bp, Artificial Sequence
  Description of Artificial Sequence: Synthetic polynucleotide
ggtacctctgaaagcgcaactcctgagtctggcccaggtagcgaacctgctacctccggctctgagactccaggtacctctgaaagcgcaaccccggaatctggtcca

SEQ ID NO: 313 - protein, 12 aa, Artificial Sequence
  Description of Artificial Sequence: Synthetic peptide
GSTSESPSGTAP

SEQ ID NO: 314 - protein, 12 aa, Artificial Sequence
  Description of Artificial Sequence: Synthetic peptide
GTSTPESGSASP

SEQ ID NO: 315 - protein, 12 aa, Artificial Sequence
  Description of Artificial Sequence: Synthetic peptide
GTSPSGESSTAP

SEQ ID NO: 316 - protein, 12 aa, Artificial Sequence
  Description of Artificial Sequence: Synthetic peptide
GSTSSTAESPGP

SEQ ID NO: 317 - DNA, 36 bp, Artificial Sequence
  Description of Artificial Sequence: Synthetic oligonucleotide
aggttctacyagcgaatcyccktctggyacygcwcc

SEQ ID NO: 318 - DNA, 36 bp, Artificial Sequence
  Description of Artificial Sequence: Synthetic oligonucleotide
acctggwgcrgtrccagamggrgattcgctrgtaga

SEQ ID NO: 319 - DNA, 36 bp, Artificial Sequence
  Description of Artificial Sequence: Synthetic oligonucleotide
aggtacytctacycckgaaagcggytcygcwtctcc

SEQ ID NO: 320 - DNA, 36 bp, Artificial Sequence
  Description of Artificial Sequence: Synthetic oligonucleotide
acctggagawgcrgarccgctttcmggrgtagargt

SEQ ID NO: 321 - DNA, 36 bp, Artificial Sequence
  Description of Artificial Sequence: Synthetic oligonucleotide
aggtacytcycckagcggygaatcttctacygcwcc

SEQ ID NO: 322 - DNA, 36 bp, Artificial Sequence
  Description of Artificial Sequence: Synthetic oligonucleotide
acctggwgcrgtagaagattcrccgctmggrgargt

SEQ ID NO: 323 - DNA, 36 bp, Artificial Sequence
  Description of Artificial Sequence: Synthetic oligonucleotide
aggttcyacyagctctacygcwgaatctcckggycc

SEQ ID NO: 324 - DNA, 36 bp, Artificial Sequence
  Description of Artificial Sequence: Synthetic oligonucleotide
acctggrccmggagattcwgcrgtagagctrgtrga

SEQ ID NO: 325 - DNA, 24 bp, Artificial Sequence
  Description of Artificial Sequence: Synthetic oligonucleotide
aggttcgtcttcactcgagggtac

SEQ ID NO: 326 - DNA, 16 bp, Artificial Sequence
  Description of Artificial Sequence: Synthetic oligonucleotide
cctcgagtgaagacga

SEQ ID NO: 327 - protein, 36 aa, Artificial Sequence
  Description of Artificial Sequence: Synthetic polypeptide
GTSTPESGSASPGTSPSGESSTAPGTSPSGESSTAP

SEQ ID NO: 328 - DNA, 108 bp, Artificial Sequence
  Description of Artificial Sequence: Synthetic polynucleotide
ggtacttctactccggaaagcggttccgcatctccaggtacttctcctagcggtgaatcttctactgctccaggtacctctcctagcggcgaatcttctactgctcca

SEQ ID NO: 329 - protein, 36 aa, Artificial Sequence
  Description of Artificial Sequence: Synthetic polypeptide
GTSPSGESSTAPGSTSSTAESPGPGTSPSGESSTAP

SEQ ID NO: 330 - DNA, 108 bp, Artificial Sequence
  Description of Artificial Sequence: Synthetic polynucleotide
ggtacttctccgagcggtgaatcttctaccgcaccaggttctactagctctaccgctgaatctccgggcccaggtacttctccgagcggtgaatcttctactgctcca

SEQ ID NO: 331 - protein, 36 aa, Artificial Sequence
  Description of Artificial Sequence: Synthetic polypeptide
GSTSSTAESPGPGTSPSGESSTAPGTSTPESGSASP

SEQ ID NO: 332 - DNA, 108 bp, Artificial Sequence
  Description of Artificial Sequence: Synthetic polynucleotide
ggttccaccagctctactgctgaatctcctggtccaggtacctctcctagcggtgaatcttctactgctccaggtacttctactcctgaaagcggctctgcttctcca

SEQ ID NO: 333 - protein, 36 aa, Artificial Sequence
  Description of Artificial Sequence: Synthetic polypeptide
GSTSSTAESPGPGSTSSTAESPGPGTSPSGESSTAP

SEQ ID NO: 334 - DNA, 108 bp, Artificial Sequence
  Description of Artificial Sequence: Synthetic polynucleotide
ggttctaccagctctactgcagaatctcctggcccaggttccaccagctctaccgcagaatctccgggtccaggtacttcccctagcggtgaatcttctaccgcacca

SEQ ID NO: 335 - protein, 36 aa, Artificial Sequence; identical to SEQ ID NO: 331
  Description of Artificial Sequence: Synthetic polypeptide

SEQ ID NO: 336 - DNA, 108 bp, Artificial Sequence
  Description of Artificial Sequence: Synthetic polynucleotide
ggttctactagctctactgctgaatctcctggcccaggtacttctcctagcggtgaatcttctaccgctccaggtacctctactccggaaagcggttctgcatctcca

SEQ ID NO: 337 - protein, 36 aa, Artificial Sequence
  Description of Artificial Sequence: Synthetic polypeptide
GSTSSTAESPGPGTSTPESGSASPGSTSESPSGTAP

SEQ ID NO: 338 - DNA, 108 bp, Artificial Sequence
  Description of Artificial Sequence: Synthetic polynucleotide
ggttctaccagctctaccgcagaatctcctggtccaggtacctctactccggaaagcggctctgcatctccaggttctactagcgaatctccttctggcactgcacca

SEQ ID NO: 339 - protein, 36 aa, Artificial Sequence
  Description of Artificial Sequence: Synthetic polypeptide
GSTSSTAESPGPGTSTPESGSASPGTSTPESGSASP

SEQ ID NO: 340 - DNA, 108 bp, Artificial Sequence
  Description of Artificial Sequence: Synthetic polynucleotide
ggttctactagctctactgcagaatctcctggcccaggtacctctactccggaaagcggctctgcatctccaggtacttctacccctgaaagcggttctgcatctcca

SEQ ID NO: 341 - protein, 36 aa, Artificial Sequence
  Description of Artificial Sequence: Synthetic polypeptide
GSTSESPSGTAPGTSPSGESSTAPGSTSESPSGTAP

SEQ ID NO: 342 - DNA, 108 bp, Artificial Sequence
  Description of Artificial Sequence: Synthetic polynucleotide
ggttctaccagcgaatctccttctggcaccgctccaggtacctctcctagcggcgaatcttctaccgctccaggttctactagcgaatctccttctggcactgcacca

SEQ ID NO: 343 - protein, 36 aa, Artificial Sequence; identical to SEQ ID NO: 333
  Description of Artificial Sequence: Synthetic polypeptide

SEQ ID NO: 344 - DNA, 108 bp, Artificial Sequence
  Description of Artificial Sequence: Synthetic polynucleotide
ggttccaccagctctactgcagaatctccgggcccaggttctactagctctactgcagaatctccgggtccaggtacttctcctagcggcgaatcttctaccgctcca

SEQ ID NO: 345 - protein, 36 aa, Artificial Sequence; identical to SEQ ID NO: 337
  Description of Artificial Sequence: Synthetic polypeptide

SEQ ID NO: 346 - DNA, 108 bp, Artificial Sequence
  Description of Artificial Sequence: Synthetic polynucleotide
ggttccactagctctactgcagaatctcctggcccaggtacctctacccctgaaagcggctctgcatctccaggttctaccagcgaatccccgtctggcaccgcacca

SEQ ID NO: 347 - protein, 36 aa, Artificial Sequence; identical to SEQ ID NO: 333
  Description of Artificial Sequence: Synthetic polypeptide

SEQ ID NO: 348 - DNA, 108 bp, Artificial Sequence
  Description of Artificial Sequence: Synthetic polynucleotide
ggttctactagctctactgctgaatctccgggtccaggttctaccagctctactgctgaatctcctggtccaggtacctccccgagcggtgaatcttctactgcacca

SEQ ID NO: 349 - protein, 36 aa, Artificial Sequence
  Description of Artificial Sequence: Synthetic polypeptide
GSTSSTAESPGPGSTSESPSGTAPGSTSSTAESPGP

SEQ ID NO: 350 - DNA, 108 bp, Artificial Sequence
  Description of Artificial Sequence: Synthetic polynucleotide
ggttctaccagctctaccgctgaatctcctggcccaggttctaccagcgaatccccgtctggcaccgcaccaggttctactagctctaccgctgaatctccgggtcca

SEQ ID NO: 351 - protein, 36 aa, Artificial Sequence
  Description of Artificial Sequence: Synthetic polypeptide
GSTSSTAESPGPGSTSSTAESPGPGSTSSTAESPGP

SEQ ID NO: 352 - DNA, 108 bp, Artificial Sequence
  Description of Artificial Sequence: Synthetic polynucleotide
ggttctaccagctctaccgcagaatctcctggcccaggttccactagctctaccgctgaatctcctggtccaggttctactagctctaccgctgaatctcctggtcca

SEQ ID NO: 353 - protein, 36 aa, Artificial Sequence
  Description of Artificial Sequence: Synthetic polypeptide
GSTSESPSGTAPGSTSSTAESPGPGSTSSTAESPGP

SEQ ID NO: 354 - DNA, 108 bp, Artificial Sequence
  Description of Artificial Sequence: Synthetic polynucleotide
ggttctactagcgaatccccttctggtactgctccaggttccactagctctaccgctgaatctcctggcccaggttccactagctctactgcagaatctcctggtcca

SEQ ID NO: 355 - protein, 36 aa, Artificial Sequence
  Description of Artificial Sequence: Synthetic polypeptide
GSTSESPSGTAPGSTSESPSGTAPGSTSESPSGTAP

SEQ ID NO: 356 - DNA, 108 bp, Artificial Sequence
  Description of Artificial Sequence: Synthetic polynucleotide
ggttctactagcgaatctccttctggtaccgctccaggttctaccagcgaatccccgtctggtactgctccaggttctaccagcgaatctccttctggtactgcacca

SEQ ID NO: 357 - protein, 36 aa, Artificial Sequence; identical to SEQ ID NO: 351
  Description of Artificial Sequence: Synthetic polypeptide

SEQ ID NO: 358 - DNA, 108 bp, Artificial Sequence
  Description of Artificial Sequence: Synthetic polynucleotide
ggttccaccagctctactgctgaatctcctggcccaggttctaccagctctactgctgaatctccgggcccaggttccaccagctctaccgctgaatctccgggtcca

SEQ ID NO: 359 - protein, 36 aa, Artificial Sequence; identical to SEQ ID NO: 333
  Description of Artificial Sequence: Synthetic polypeptide

SEQ ID NO: 360 - DNA, 108 bp, Artificial Sequence
  Description of Artificial Sequence: Synthetic polynucleotide
ggttccactagctctaccgcagaatctcctggtccaggttctactagctctactgctgaatctccgggtccaggtacctcccctagcggcgaatcttctaccgctcca

SEQ ID NO: 361 - protein, 36 aa, Artificial Sequence
  Description of Artificial Sequence: Synthetic polypeptide
GSSPSASTGTGPGSSTPSGATGSPGSSTPSGATGSP

SEQ ID NO: 362 - DNA, 108 bp, Artificial Sequence
  Description of Artificial Sequence: Synthetic polynucleotide
ggttctagcccttctgcttccaccggtaccggcccaggtagctctactccgtctggtgcaactggctctccaggtagctctactccgtctggtgcaaccggctcccca

SEQ ID NO: 363 - protein, 36 aa, Artificial Sequence
  Description of Artificial Sequence: Synthetic polypeptide
GTSPSGESSTAPGTSTPESGSASPGSTSSTAESPGP

SEQ ID NO: 364 - DNA, 108 bp, Artificial Sequence
  Description of Artificial Sequence: Synthetic polynucleotide
ggtacttcccctagcggtgaatcttctactgctccaggtacctctactccggaaagcggctccgcatctccaggttctactagctctactgctgaatctcctggtcca

SEQ ID NO: 365 - protein, 36 aa, Artificial Sequence
  Description of Artificial Sequence: Synthetic polypeptide
GSTSSTAESPGPGSTSSTAESPGPGTSTPESGSASP

SEQ ID NO: 366 - DNA, 108 bp, Artificial Sequence
  Description of Artificial Sequence: Synthetic polynucleotide
ggttctactagctctaccgctgaatctccgggtccaggttctaccagctctactgcagaatctcctggcccaggtacttctactccggaaagcggttccgcttctcca

SEQ ID NO: 367 - protein, 36 aa, Artificial Sequence
  Description of Artificial Sequence: Synthetic polypeptide
GTSPSGESSTAPGSTSSTAESPGPGTSTPESGSASP

SEQ ID NO: 368 - DNA, 108 bp, Artificial Sequence
  Description of Artificial Sequence: Synthetic polynucleotide
ggtacttctcctagcggtgaatcttctaccgctccaggttctaccagctctactgctgaatctcctggcccaggtacttctaccccggaaagcggctccgcttctcca

SEQ ID NO: 369 - protein, 36 aa, Artificial Sequence; identical to SEQ ID NO: 353
  Description of Artificial Sequence: Synthetic polypeptide

SEQ ID NO: 370 - DNA, 108 bp, Artificial Sequence
  Description of Artificial Sequence: Synthetic polynucleotide
ggttctactagcgaatccccttctggtactgcaccaggttctaccagctctactgctgaatctccgggcccaggttccaccagctctaccgcagaatctcctggtcca

SEQ ID NO: 371 - protein, 36 aa, Artificial Sequence; identical to SEQ ID NO: 349
  Description of Artificial Sequence: Synthetic polypeptide

SEQ ID NO: 372 - DNA, 108 bp, Artificial Sequence
  Description of Artificial Sequence: Synthetic polynucleotide
ggttccaccagctctaccgctgaatctccgggcccaggttctaccagcgaatccccttctggcactgcaccaggttctactagctctaccgcagaatctccgggccca

SEQ ID NO: 373 - protein, 36 aa, Artificial Sequence; identical to SEQ ID NO: 331
  Description of Artificial Sequence: Synthetic polypeptide

SEQ ID NO: 374 - DNA, 108 bp, Artificial Sequence
  Description of Artificial Sequence: Synthetic polynucleotide
ggttctaccagctctactgctgaatctccgggtccaggtacttccccgagcggtgaatcttctactgcaccaggtacttctactccggaaagcggttccgcttctcca

SEQ ID NO: 375 - protein, 36 aa, Artificial Sequence
  Description of Artificial Sequence: Synthetic polypeptide
GSTSESPSGTAPGSTSESPSGTAPGTSPSGESSTAP

SEQ ID NO: 376 - DNA, 108 bp, Artificial Sequence
  Description of Artificial Sequence: Synthetic polynucleotide
ggttctaccagcgaatctccttctggcaccgctccaggttctactagcgaatccccgtctggtaccgcaccaggtacttctcctagcggcgaatcttctaccgcacca

SEQ ID NO: 377 - protein, 36 aa, Artificial Sequence
  Description of Artificial Sequence: Synthetic polypeptide
GSTSESPSGTAPGSTSESPSGTAPGTSTPESGSASP

SEQ ID NO: 378 - DNA, 108 bp, Artificial Sequence
  Description of Artificial Sequence: Synthetic polynucleotide
ggttctaccagcgaatccccttctggtactgctccaggttctaccagcgaatccccttctggcaccgcaccaggtacttctacccctgaaagcggctccgcttctcca

SEQ ID NO: 379 - protein, 36 aa, Artificial Sequence
  Description of Artificial Sequence: Synthetic polypeptide
GTSTPESGSASPGSTSSTAESPGPGSTSSTAESPGP

SEQ ID NO: 380 - DNA, 108 bp, Artificial Sequence
  Description of Artificial Sequence: Synthetic polynucleotide
ggtacctctactcctgaaagcggttctgcatctccaggttccactagctctaccgcagaatctccgggcccaggttctactagctctactgctgaatctcctggccca

SEQ ID NO: 381 - protein, 36 aa, Artificial Sequence; identical to SEQ ID NO: 375
  Description of Artificial Sequence: Synthetic polypeptide

SEQ ID NO: 382 - DNA, 108 bp, Artificial Sequence
  Description of Artificial Sequence: Synthetic polynucleotide
ggttctaccagcgaatccccttctggcactgcaccaggttctactagcgaatccccttctggtaccgcaccaggtacttctccgagcggcgaatcttctactgctcca

SEQ ID NO: 383 - protein, 36 aa, Artificial Sequence
  Description of Artificial Sequence: Synthetic polypeptide
GSTSSTAESPGPGSTSSTAESPGPGSTSESPSGTAP

SEQ ID NO: 384 - DNA, 108 bp, Artificial Sequence
  Description of Artificial Sequence: Synthetic polynucleotide
ggttctactagctctaccgctgaatctcctggcccaggttccactagctctaccgcagaatctccgggcccaggttctactagcgaatccccttctggtaccgctcca

SEQ ID NO: 385 - protein, 36 aa, Artificial Sequence; identical to SEQ ID NO: 365
  Description of Artificial Sequence: Synthetic polypeptide

SEQ ID NO: 386 - DNA, 108 bp, Artificial Sequence
  Description of Artificial Sequence: Synthetic polynucleotide
ggttccaccagctctactgcagaatctcctggcccaggttctactagctctaccgcagaatctcctggtccaggtacctctactcctgaaagcggttccgcatctcca

SEQ ID NO: 387 - protein, 36 aa, Artificial Sequence; identical to SEQ ID NO: 383
  Description of Artificial Sequence: Synthetic polypeptide

SEQ ID NO: 388 - DNA, 108 bp, Artificial Sequence
  Description of Artificial Sequence: Synthetic polynucleotide
ggttctactagctctactgctgaatctccgggcccaggttctactagctctaccgctgaatctccgggtccaggttctactagcgaatctccttctggtaccgctcca

SEQ ID NO: 389 - protein, 36 aa, Artificial Sequence
  Description of Artificial Sequence: Synthetic polypeptide
GTSPSGESSTAPGSTSESPSGTAPGSTSSTAESPGP

SEQ ID NO: 390 - DNA, 108 bp, Artificial Sequence
  Description of Artificial Sequence: Synthetic polynucleotide
ggtacctccccgagcggtgaatcttctactgcaccaggttctactagcgaatccccttctggtactgctccaggttccaccagctctactgcagaatctccgggtcca

SEQ ID NO: 391 - protein, 36 aa, Artificial Sequence
  Description of Artificial Sequence: Synthetic polypeptide
GSTSESPSGTAPGTSPSGESSTAPGSTSSTAESPGP

SEQ ID NO: 392 - DNA, 108 bp, Artificial Sequence
  Description of Artificial Sequence: Synthetic polynucleotide
ggttctactagcgaatccccgtctggtactgctccaggtacttcccctagcggtgaatcttctactgctccaggttctaccagctctaccgcagaatctccgggtcca

SEQ ID NO: 393 - protein, 36 aa, Artificial Sequence
  Description of Artificial Sequence: Synthetic polypeptide
GSTSSTAESPGPGSTSESPSGTAPGTSPSGESSTAP

SEQ ID NO: 394 - DNA, 108 bp, Artificial Sequence
  Description of Artificial Sequence: Synthetic polynucleotide
ggttctaccagctctaccgctgaatctcctggcccaggttctactagcgaatctccgtctggcaccgcaccaggtacttcccctagcggtgaatcttctactgcacca

SEQ ID NO: 395 - protein, 36 aa, Artificial Sequence; identical to SEQ ID NO: 377
  Description of Artificial Sequence: Synthetic polypeptide

SEQ ID NO: 396 - DNA, 108 bp, Artificial Sequence
  Description of Artificial Sequence: Synthetic polynucleotide
ggttctactagcgaatctccttctggcactgcaccaggttctaccagcgaatctccgtctggcactgcaccaggtacctctacccctgaaagcggttccgcttctcca

SEQ ID NO: 397 - protein, 36 aa, Artificial Sequence
  Description of Artificial Sequence: Synthetic polypeptide
GTSTPESGSASPGSTSESPSGTAPGSTSSTAESPGP

SEQ ID NO: 398 - DNA, 108 bp, Artificial Sequence
  Description of Artificial Sequence: Synthetic polynucleotide
ggtacctctactccggaaagcggttccgcatctccaggttctaccagcgaatccccgtctggcaccgcaccaggttctactagctctactgctgaatctccgggccca

SEQ ID NO: 399 - protein, 36 aa, Artificial Sequence
  Description of Artificial Sequence: Synthetic polypeptide
GSTSSTAESPGPGTSPSGESSTAPGTSPSGESSTAP

SEQ ID NO: 400 - DNA, 108 bp, Artificial Sequence
  Description of Artificial Sequence: Synthetic polynucleotide
ggttctactagctctactgcagaatctccgggcccaggtacctctcctagcggtgaatcttctaccgctccaggtacttctccgagcggtgaatcttctaccgctcca

SEQ ID NO: 401 - protein, 36 aa, Artificial Sequence
  Description of Artificial Sequence: Synthetic polypeptide
GTSPSGESSTAPGTSPSGESSTAPGTSPSGESSTAP

SEQ ID NO: 402 - DNA, 108 bp, Artificial Sequence
  Description of Artificial Sequence: Synthetic polynucleotide
ggtacctcccctagcggcgaatcttctactgctccaggtacctctcctagcggcgaatcttctaccgctccaggtacctcccctagcggtgaatcttctaccgcacca

SEQ ID NO: 403 - protein, 36 aa, Artificial Sequence; identical to SEQ ID NO: 337
  Description of Artificial Sequence: Synthetic polypeptide

SEQ ID NO: 404 - DNA, 108 bp, Artificial Sequence
  Description of Artificial Sequence: Synthetic polynucleotide
ggttccactagctctactgctgaatctcctggcccaggtacttctactccggaaagcggttccgcttctccaggttctactagcgaatctccgtctggcaccgcacca

SEQ ID NO: 405 - protein, 36 aa, Artificial Sequence
  Description of Artificial Sequence: Synthetic polypeptide
GSTSESPSGTAPGTSPSGESSTAPGTSPSGESSTAP

SEQ ID NO: 406 - DNA, 108 bp, Artificial Sequence
  Description of Artificial Sequence: Synthetic polynucleotide
ggttctactagcgaatctccgtctggcactgctccaggtacttctcctagcggtgaatcttctaccgctccaggtacttcccctagcggcgaatcttctaccgctcca

SEQ ID NO: 407 - protein, 36 aa, Artificial Sequence
  Description of Artificial Sequence: Synthetic polypeptide
GSTSESPSGTAPGTSTPESGSASPGSTSSTAESPGP

SEQ ID NO: 408 - DNA, 108 bp, Artificial Sequence
  Description of Artificial Sequence: Synthetic polynucleotide
ggttctactagcgaatctccttctggtaccgctccaggtacttctacccctgaaagcggctccgcttctccaggttccactagctctaccgctgaatctccgggtcca

SEQ ID NO: 409 - protein, 36 aa, Artificial Sequence; identical to SEQ ID NO: 383
  Description of Artificial Sequence: Synthetic polypeptide

SEQ ID NO: 410 - DNA, 108 bp, Artificial Sequence
  Description of Artificial Sequence: Synthetic polynucleotide
ggttccactagctctactgctgaatctcctggcccaggttctaccagctctaccgctgaatctcctggcccaggttctaccagcgaatctccgtctggcaccgcacca

SEQ ID NO: 411 - protein, 36 aa, Artificial Sequence
  Description of Artificial Sequence: Synthetic polypeptide
GSTSESPSGTAPGTSTPESGSASPGTSTPESGSASP

SEQ ID NO: 412 - DNA, 108 bp, Artificial Sequence
  Description of Artificial Sequence: Synthetic polynucleotide
ggttctactagcgaatccccgtctggtaccgcaccaggtacttctaccccggaaagcggctctgcttctccaggtacttctaccccggaaagcggctccgcatctcca

SEQ ID NO: 413 - protein, 36 aa, Artificial Sequence; identical to SEQ ID NO: 411
  Description of Artificial Sequence: Synthetic polypeptide

SEQ ID NO: 414 - DNA, 108 bp, Artificial Sequence
  Description of Artificial Sequence: Synthetic polynucleotide
ggttctactagcgaatccccgtctggtactgctccaggtacttctactcctgaaagcggttccgcttctccaggtacctctactccggaaagcggttctgcatctcca

SEQ ID NO: 415 - protein, 12 aa, Artificial Sequence
  Description of Artificial Sequence: Synthetic peptide
GTPGSGTASSSP

SEQ ID NO: 416 - protein, 12 aa, Artificial Sequence
  Description of Artificial Sequence: Synthetic peptide
GSSTPSGATGSP

SEQ ID NO: 417 - protein, 12 aa, Artificial Sequence
  Description of Artificial Sequence: Synthetic peptide
GSSPSASTGTGP

SEQ ID NO: 418 - protein, 12 aa, Artificial Sequence
  Description of Artificial Sequence: Synthetic peptide
GASPGTSSTGSP

SEQ ID NO: 419 - DNA, 36 bp, Artificial Sequence
  Description of Artificial Sequence: Synthetic oligonucleotide
aggtacycckggyagcggtacygcwtcttcytctcc

SEQ ID NO: 420 - DNA, 36 bp, Artificial Sequence
  Description of Artificial Sequence: Synthetic oligonucleotide
acctggagargaagawgcrgtaccgctrccmggrgt

SEQ ID NO: 421 - DNA, 36 bp, Artificial Sequence
  Description of Artificial Sequence: Synthetic oligonucleotide
aggtagctctacyccktctggtgcwacyggytcycc

SEQ ID NO: 422 - DNA, 36 bp, Artificial Sequence
  Description of Artificial Sequence: Synthetic oligonucleotide
acctggrgarccrgtwgcaccagamggrgtagagct

SEQ ID NO: 423 - DNA, 36 bp, Artificial Sequence
  Description of Artificial Sequence: Synthetic oligonucleotide
aggttctagcccktctgcwtcyacyggtacyggycc

SEQ ID NO: 424 - DNA, 36 bp, Artificial Sequence
  Description of Artificial Sequence: Synthetic oligonucleotide
acctggrccrgtaccrgtrgawgcagamgggctaga

SEQ ID NO: 425 - DNA, 36 bp, Artificial Sequence
  Description of Artificial Sequence: Synthetic oligonucleotide
aggtgcwtcycckggyacyagctctacyggttctcc

SEQ ID NO: 426 - DNA, 36 bp, Artificial Sequence
  Description of Artificial Sequence: Synthetic oligonucleotide
acctggagaaccrgtagagctrgtrccmggrgawgc

SEQ ID NO: 427 - DNA, 24 bp, Artificial Sequence
  Description of Artificial Sequence: Synthetic oligonucleotide
aggttcgtcttcactcgagggtac

SEQ ID NO: 428 - DNA, 16 bp, Artificial Sequence
  Description of Artificial Sequence: Synthetic oligonucleotide
cctcgagtgaagacga

SEQ ID NO: 429 - protein, 36 aa, Artificial Sequence
  Description of Artificial Sequence: Synthetic polypeptide
GASPGTSSTGSPGTPGSGTASSSPGSSTPSGATGSP

SEQ ID NO: 430 - DNA, 108 bp, Artificial Sequence
  Description of Artificial Sequence: Synthetic polynucleotide
ggtgcatccccgggcactagctctaccggttctccaggtactcctggtagcggtactgcttcttcttctccaggtagctctactccttctggtgctactggttctcca

SEQ ID NO: 431 - protein, 36 aa, Artificial Sequence
  Description of Artificial Sequence: Synthetic polypeptide
GSSTPSGATGSPGSSPSASTGTGPGSSTPSGATGSP

SEQ ID NO: 432 - DNA, 108 bp, Artificial Sequence
  Description of Artificial Sequence: Synthetic polynucleotide
ggtagctctaccccttctggtgctaccggctctccaggttctagcccgtctgcttctaccggtaccggtccaggtagctctaccccttctggtgctactggttctcca

SEQ ID NO: 433 - protein, 36 aa, Artificial Sequence
  Description of Artificial Sequence: Synthetic polypeptide
GASPGTSSTGSPGSSPSASTGTGPGSSTPSGATGSP

SEQ ID NO: 434 - DNA, 108 bp, Artificial Sequence
  Description of Artificial Sequence: Synthetic polynucleotide
ggtgcatctccgggtactagctctaccggttctccaggttctagcccttctgcttccactggtaccggcccaggtagctctaccccgtctggtgctactggttcccca

SEQ ID NO: 435 - protein, 36 aa, Artificial Sequence
  Description of Artificial Sequence: Synthetic polypeptide
GTPGSGTASSSPGSSTPSGATGSPGASPGTSSTGSP

SEQ ID NO: 436 - DNA, 108 bp, Artificial Sequence
  Description of Artificial Sequence: Synthetic polynucleotide
ggtactccgggcagcggtactgcttcttcctctccaggtagctctaccccttctggtgcaactggttccccaggtgcatcccctggtactagctctaccggttctcca

SEQ ID NO: 437 - protein, 36 aa, Artificial Sequence
  Description of Artificial Sequence: Synthetic polypeptide
GTPGSGTASSSPGASPGTSSTGSPGSRPSASTGTGP

SEQ ID NO: 438 - DNA, 108 bp, Artificial Sequence
  Description of Artificial Sequence: Synthetic polynucleotide
ggtacccctggcagcggtactgcttcttcttctccaggtgcttcccctggtaccagctctaccggttctccaggttctagaccttctgcatccaccggtactggtcca

SEQ ID NO: 439 - protein, 36 aa, Artificial Sequence
  Description of Artificial Sequence: Synthetic polypeptide
GASPGTSSTGSPGSSTPSGATGSPGASPGTSSTGSP

SEQ ID NO: 440 - DNA, 108 bp, Artificial Sequence
  Description of Artificial Sequence: Synthetic polynucleotide
ggtgcatctcctggtaccagctctaccggttctccaggtagctctactccttctggtgctactggctctccaggtgcttccccgggtaccagctctaccggttctcca

SEQ ID NO: 441 - protein, 36 aa, Artificial Sequence
  Description of Artificial Sequence: Synthetic polypeptide
GTPGSGTASSSPGSSTPSGATGSPGSSTPSGATGSP

SEQ ID NO: 442 - DNA, 108 bp, Artificial Sequence
  Description of Artificial Sequence: Synthetic polynucleotide
ggtaccccgggcagcggtaccgcatcttcctctccaggtagctctaccccgtctggtgctaccggttccccaggtagctctaccccgtctggtgcaaccggctcccca

SEQ ID NO: 443 - protein, 36 aa, Artificial Sequence
  Description of Artificial Sequence: Synthetic polypeptide
GASPGTSSTGSPGASPGTSSTGSPGASPGTSSTGSP

SEQ ID NO: 444 - DNA, 108 bp, Artificial Sequence
  Description of Artificial Sequence: Synthetic polynucleotide
ggtgcatctccgggcactagctctactggttctccaggtgcatcccctggcactagctctactggttctccaggtgcttctcctggtaccagctctactggttctcca

SEQ ID NO: 445 - protein, 36 aa, Artificial Sequence
  Description of Artificial Sequence: Synthetic polypeptide
GSSTPSGATGSPGSSPSASTGTGPGASPGTSSTGSP

SEQ ID NO: 446 - DNA, 108 bp, Artificial Sequence
  Description of Artificial Sequence: Synthetic polynucleotide
ggtagctctactccgtctggtgcaaccggctccccaggttctagcccgtctgcttccactggtactggcccaggtgcttccccgggcaccagctctactggttctcca

SEQ ID NO: 447 - protein, 36 aa, Artificial Sequence
  Description of Artificial Sequence: Synthetic polypeptide
GSSTPSGATGSPGSSTPSGATGSPGTPGSGTASSSP

SEQ ID NO: 448 - DNA, 108 bp, Artificial Sequence
  Description of Artificial Sequence: Synthetic polynucleotide
ggtagctctactccttctggtgctaccggttccccaggtagctctactccttctggtgctactggttccccaggtactccgggcagcggtactgcttcttcctctcca

SEQ ID NO: 449 - protein, 36 aa, Artificial Sequence
  Description of Artificial Sequence: Synthetic polypeptide
GSSTPSGATGSPGSSTPSGATGSPGASPGTSSTGSP

SEQ ID NO: 450 - DNA, 108 bp, Artificial Sequence
  Description of Artificial Sequence: Synthetic polynucleotide
ggtagctctactccgtctggtgcaaccggttccccaggtagctctactccttctggtgctactggctccccaggtgcatcccctggcaccagctctaccggttctcca

SEQ ID NO: 451 - protein, 36 aa, Artificial Sequence
  Description of Artificial Sequence: Synthetic polypeptide
GTPGSGTASSSPGSSPSASTGTGPGSSTPSGATGSP

SEQ ID NO: 452 - DNA, 108 bp, Artificial Sequence
  Description of Artificial Sequence: Synthetic polynucleotide
ggtactcctggtagcggtaccgcatcttcctctccaggttctagcccttctgcatctaccggtaccggtccaggtagctctactccttctggtgctactggctctcca

SEQ ID NO: 453 - protein, 36 aa, Artificial Sequence
  Description of Artificial Sequence: Synthetic polypeptide
GASPGTSSTGSPGSSPSASTGTGPGTPGSGTASSSP

SEQ ID NO: 454 - DNA, 108 bp, Artificial Sequence
  Description of Artificial Sequence: Synthetic polynucleotide
ggtgcttccccgggcactagctctaccggttctccaggttctagcccttctgcatctactggtactggcccaggtactccgggcagcggtactgcttcttcctctcca

SEQ ID NO: 455 - protein, 36 aa, Artificial Sequence; identical to SEQ ID NO: 449
  Description of Artificial Sequence: Synthetic polypeptide

SEQ ID NO: 456 - DNA, 108 bp, Artificial Sequence
  Description of Artificial Sequence: Synthetic polynucleotide
ggtagctctactccgtctggtgctaccggctctccaggtagctctaccccttctggtgcaaccggctccccaggtgcttctccgggtaccagctctactggttctcca

SEQ ID NO: 457 - protein, 36 aa, Artificial Sequence
  Description of Artificial Sequence: Synthetic polypeptide
GTPGSGTASSSPGSSTPSGATGSPGSSPSASTGTGP

SEQ ID NO: 458 - DNA, 108 bp, Artificial Sequence
  Description of Artificial Sequence: Synthetic polynucleotide
ggtacccctggcagcggtaccgcttcttcctctccaggtagctctaccccgtctggtgctactggctctccaggttctagcccgtctgcatctaccggtaccggccca

SEQ ID NO: 459 - protein, 36 aa, Artificial Sequence
  Description of Artificial Sequence: Synthetic polypeptide
GSSTPSGATGSPGTPGSGTASSSPGTPGSGTASSSP

SEQ ID NO: 460 - DNA, 108 bp, Artificial Sequence
  Description of Artificial Sequence: Synthetic polynucleotide
ggtagctctactccttctggtgcaaccggctccccaggtaccccgggcagcggtaccgcatcttcctctccaggtactccgggtagcggtactgcttcttcttctcca

SEQ ID NO: 461 - protein, 36 aa, Artificial Sequence; identical to SEQ ID NO: 435
  Description of Artificial Sequence: Synthetic polypeptide

SEQ ID NO: 462 - DNA, 108 bp, Artificial Sequence
  Description of Artificial Sequence: Synthetic polynucleotide
ggtaccccgggtagcggtactgcttcttcctctccaggtagctctaccccttctggtgcaaccggctctccaggtgcttctccgggcaccagctctaccggttctcca

SEQ ID NO: 463 - protein, 36 aa, Artificial Sequence; identical to SEQ ID NO: 449
  Description of Artificial Sequence: Synthetic polypeptide

SEQ ID NO: 464 - DNA, 108 bp, Artificial Sequence
  Description of Artificial Sequence: Synthetic polynucleotide
ggtagctctaccccgtctggtgctaccggctctccaggtagctctaccccgtctggtgcaaccggctccccaggtgcatccccgggtactagctctaccggttctcca

SEQ ID NO: 465 - protein, 36 aa, Artificial Sequence; identical to SEQ ID NO: 429
  Description of Artificial Sequence: Synthetic polypeptide

SEQ ID NO: 466 - DNA, 108 bp, Artificial Sequence
  Description of Artificial Sequence: Synthetic polynucleotide
ggtgcttctccgggcaccagctctactggttctccaggtaccccgggcagcggtaccgcatcttcttctccaggtagctctactccttctggtgcaactggttctcca

SEQ ID NO: 467 - protein, 36 aa, Artificial Sequence
  Description of Artificial Sequence: Synthetic polypeptide
GSSPSASTGTGPGSSTPSGATGSPGTPGSGTASSSP

SEQ ID NO: 468 - DNA, 108 bp, Artificial Sequence
  Description of Artificial Sequence: Synthetic polynucleotide
ggttctagcccgtctgcttccaccggtactggcccaggtagctctaccccgtctggtgcaactggttccccaggtacccctggtagcggtaccgcttcttcttctcca

SEQ ID NO: 469 - protein, 36 aa, Artificial Sequence; identical to SEQ ID NO: 433
  Description of Artificial Sequence: Synthetic polypeptide

SEQ ID NO: 470 - DNA, 108 bp, Artificial Sequence
  Description of Artificial Sequence: Synthetic polynucleotide
ggtgcttctccgggcaccagctctactggttctccaggttctagcccttctgcatccaccggtaccggtccaggtagctctaccccttctggtgcaaccggctctcca

SEQ ID NO: 471 - protein, 36 aa, Artificial Sequence
  Description of Artificial Sequence: Synthetic polypeptide
GASPGTSSTGSPGSSTPSGATGSPGSSTPSGATGSP

SEQ ID NO: 472 - DNA, 108 bp, Artificial Sequence
  Description of Artificial Sequence: Synthetic polynucleotide
ggtgcatccccgggcaccagctctaccggttctccaggtagctctaccccgtctggtgctaccggctctccaggtagctctaccccgtctggtgctactggctctcca

SEQ ID NO: 473 - protein, 36 aa, Artificial Sequence
  Description of Artificial Sequence: Synthetic polypeptide
GTPGSGTASSSPGSSTPSGATGSPGTPGSGTASSSP

SEQ ID NO: 474 - DNA, 108 bp, Artificial Sequence
  Description of Artificial Sequence: Synthetic polynucleotide
ggtacccctggtagcggtactgcttcttcctctccaggtagctctactccgtctggtgctaccggttctccaggtaccccgggtagcggtaccgcatcttcttctcca

SEQ ID NO: 475 - protein, 36 aa, Artificial Sequence; identical to SEQ ID NO: 361
  Description of Artificial Sequence: Synthetic polypeptide

SEQ ID NO: 476 - DNA, 108 bp, Artificial Sequence
  Description of Artificial Sequence: Synthetic polynucleotide
ggttctagcccttctgcttccaccggtactggcccaggtagctctaccccttctggtgctaccggctccccaggtagctctactccttctggtgcaactggctctcca

SEQ ID NO: 477 - protein, 36 aa, Artificial Sequence
  Description of Artificial Sequence: Synthetic polypeptide
GASPGTSSTGSPGSSPSASTGTGPGSSPSASTGTGP

SEQ ID NO: 478 - DNA, 108 bp, Artificial Sequence
  Description of Artificial Sequence: Synthetic polynucleotide
ggtgcttctcctggcaccagctctactggttctccaggttctagcccttctgcttctaccggtactggtccaggttctagcccttctgcatccactggtactggtcca

SEQ ID NO: 479 - protein, 36 aa, Artificial Sequence
  Description of Artificial Sequence: Synthetic polypeptide
GTPGSGTASSSPGASPGTSSTGSPGASPGTSSTGSP

SEQ ID NO: 480 - DNA, 108 bp, Artificial Sequence
  Description of Artificial Sequence: Synthetic polynucleotide
ggtactcctggcagcggtaccgcttcttcttctccaggtgcttctcctggtactagctctactggttctccaggtgcttctccgggcactagctctactggttctcca

SEQ ID NO: 481 - protein, 36 aa, Artificial Sequence
  Description of Artificial Sequence: Synthetic polypeptide
GSSTPSGATGSPGASPGTSSTGSPGSSTPSGATGSP

SEQ ID NO: 482 - DNA, 108 bp, Artificial Sequence
  Description of Artificial Sequence: Synthetic polynucleotide
ggtagctctaccccgtctggtgctaccggttccccaggtgcttctcctggtactagctctaccggttctccaggtagctctaccccgtctggtgctactggctctcca

SEQ ID NO: 483 - protein, 36 aa, Artificial Sequence
  Description of Artificial Sequence: Synthetic polypeptide
GSSTPSGATGSPGTPGSGTASSSPGSSTPSGATGSP

SEQ ID NO: 484 - DNA, 108 bp, Artificial Sequence
  Description of Artificial Sequence: Synthetic polynucleotide
ggtagctctaccccgtctggtgctactggttctccaggtactccgggcagcggtactgcttcttcctctccaggtagctctaccccttctggtgctactggctctcca

SEQ ID NO: 485 - protein, 36 aa, Artificial Sequence; identical to SEQ ID NO: 433
  Description of Artificial Sequence: Synthetic polypeptide

SEQ ID NO: 486 - DNA, 108 bp, Artificial Sequence
  Description of Artificial Sequence: Synthetic polynucleotide
ggtgcatctcctggtaccagctctactggttctccaggttctagcccttctgcttctaccggtaccggtccaggtagctctactccttctggtgctaccggttctcca

SEQ ID NO: 487 - protein, 36 aa, Artificial Sequence
  Description of Artificial Sequence: Synthetic polypeptide
GSSTPSGATGSPGSSTPSGATGSPGSSTPSGATGSP

SEQ ID NO: 488 - DNA, 108 bp, Artificial Sequence
  Description of Artificial Sequence: Synthetic polynucleotide
ggtagctctaccccgtctggtgctactggctctccaggtagctctactccttctggtgctactggttccccaggtagctctaccccgtctggtgcaactggctctcca

SEQ ID NO: 489 - protein, 36 aa, Artificial Sequence
  Description of Artificial Sequence: Synthetic polypeptide
GASPGTSSTGSPGTPGSGTASSSPGASPGTSSTGSP

SEQ ID NO: 490 - DNA, 108 bp, Artificial Sequence
  Description of Artificial Sequence: Synthetic polynucleotide
ggtgcatccccgggtaccagctctaccggttctccaggtactcctggcagcggtactgcatcttcctctccaggtgcttctccgggcaccagctctactggttctcca

SEQ ID NO: 491 - protein, 36 aa, Artificial Sequence; identical to SEQ ID NO: 445
  Description of Artificial Sequence: Synthetic polypeptide

SEQ ID NO: 492 - DNA, 108 bp, Artificial Sequence
  Description of Artificial Sequence: Synthetic polynucleotide
ggtagctctactccttctggtgcaactggttctccaggttctagcccgtctgcatccactggtaccggtccaggtgcttcccctggcaccagctctaccggttctcca

SEQ ID NO: 493 - protein, 36 aa, Artificial Sequence
  Description of Artificial Sequence: Synthetic polypeptide
GASPGTSSTGSPGSSTPSGATGSPGSSPSASTGTGP

SEQ ID NO: 494 - DNA, 108 bp, Artificial Sequence
  Description of Artificial Sequence: Synthetic polynucleotide
ggtgcatctcctggtactagctctactggttctccaggtagctctactccgtctggtgcaaccggctctccaggttctagcccttctgcatctaccggtactggtcca

SEQ ID NO: 495 - protein, 36 aa, Artificial Sequence; identical to SEQ ID NO: 435
  Description of Artificial Sequence: Synthetic polypeptide

SEQ ID NO: 496 - DNA, 108 bp, Artificial Sequence
  Description of Artificial Sequence: Synthetic polynucleotide
ggtactcctggcagcggtaccgcatcttcctctccaggtagctctactccgtctggtgcaactggttccccaggtgcttctccgggtaccagctctaccggttctcca

SEQ ID NO: 497 - protein, 36 aa, Artificial Sequence; identical to SEQ ID NO: 483
  Description of Artificial Sequence: Synthetic polypeptide

SEQ ID NO: 498 - DNA, 108 bp, Artificial Sequence
  Description of Artificial Sequence: Synthetic polynucleotide
ggtagctctaccccgtctggtgcaaccggctccccaggtactcctggtagcggtaccgcttcttcttctccaggtagctctactccgtctggtgctaccggctcccca

SEQ ID NO: 499 - protein, 36 aa, Artificial Sequence
  Description of Artificial Sequence: Synthetic polypeptide
GSSPSASTGTGPGSSPSASTGTGPGASPGTSSTGSP

SEQ ID NO: 500 - DNA, 108 bp, Artificial Sequence
  Description of Artificial Sequence: Synthetic polynucleotide
ggttctagcccttctgcatccaccggtaccggcccaggttctagcccgtctgcttctaccggtactggtccaggtgcttctccgggtactagctctactggttctcca

SEQ ID NO: 501 - protein, 36 aa, Artificial Sequence
  Description of Artificial Sequence: Synthetic polypeptide
GTPGSGTASSSPGSSTPSGATGSPGSNPSASTGTGP

SEQ ID NO: 502 - DNA, 108 bp, Artificial Sequence
  Description of Artificial Sequence: Synthetic polynucleotide
ggtaccccgggtagcggtaccgcttcttcttctccaggtagctctactccgtctggtgctaccggctctccaggttctaacccttctgcatccaccggtaccggccca

SEQ ID NO: 503 - protein, 36 aa, Artificial Sequence
  Description of Artificial Sequence: Synthetic polypeptide
GSSPSASTGTGPGSSTPSGATGSPGASPGTSSTGSP

SEQ ID NO: 504 - DNA, 108 bp, Artificial Sequence
  Description of Artificial Sequence: Synthetic polynucleotide
ggttctagcccttctgcatctactggtactggcccaggtagctctactccttctggtgctaccggctctccaggtgcttctccgggtactagctctaccggttctcca

SEQ ID NO: 505 - protein, 36 aa, Artificial Sequence
  Description of Artificial Sequence: Synthetic polypeptide
GSSTPSGATGSPGASPGTSSTGSPGTPGSGTASSSP

SEQ ID NO: 506 - DNA, 108 bp, Artificial Sequence
  Description of Artificial Sequence: Synthetic polynucleotide
ggtagctctaccccttctggtgcaaccggctctccaggtgcatccccgggtaccagctctaccggttctccaggtactccgggtagcggtaccgcttcttcctctcca

SEQ ID NO: 507 - protein, 36 aa, Artificial Sequence; identical to SEQ ID NO: 487
  Description of Artificial Sequence: Synthetic polypeptide

SEQ ID NO: 508 - DNA, 108 bp, Artificial Sequence
  Description of Artificial Sequence: Synthetic polynucleotide
ggtagctctactccgtctggtgcaaccggttccccaggtagctctaccccttctggtgcaaccggctccccaggtagctctaccccttctggtgcaactggctctcca

SEQ ID NO: 509 - protein, 36 aa, Artificial Sequence; identical to SEQ ID NO: 429
  Description of Artificial Sequence: Synthetic polypeptide

SEQ ID NO: 510 - DNA, 108 bp, Artificial Sequence
  Description of Artificial Sequence: Synthetic polynucleotide
ggtgcttctcctggcactagctctaccggttctccaggtacccctggtagcggtaccgcatcttcctctccaggtagctctactccttctggtgctactggttcccca

SEQ ID NO: 511 - protein, 36 aa, Artificial Sequence
  Description of Artificial Sequence: Synthetic polypeptide
GSSTPSGATGSPGSSPSASTGTGPGSSPSASTGTGP

SEQ ID NO: 512 - DNA, 108 bp, Artificial Sequence
  Description of Artificial Sequence: Synthetic polynucleotide
ggtagctctaccccgtctggtgctactggctccccaggttctagcccttctgcatccaccggtaccggtccaggttctagcccgtctgcatctactggtactggtcca

SEQ ID NO: 513 - protein, 36 aa, Artificial Sequence; identical to SEQ ID NO: 477
  Description of Artificial Sequence: Synthetic polypeptide

SEQ ID NO: 514 - DNA, 108 bp, Artificial Sequence
  Description of Artificial Sequence: Synthetic polynucleotide
ggtgcttccccgggcaccagctctactggttctccaggttctagcccgtctgcttctactggtactggtccaggttctagcccttctgcttccactggtactggtcca

SEQ ID NO: 515 - protein, 36 aa, Artificial Sequence; identical to SEQ ID NO: 453
  Description of Artificial Sequence: Synthetic polypeptide

SEQ ID NO: 516 - DNA, 108 bp, Artificial Sequence
  Description of Artificial Sequence: Synthetic polynucleotide
ggtgcttccccgggtaccagctctaccggttctccaggttctagcccttctgcttctaccggtaccggtccaggtacccctggcagcggtaccgcatcttcctctcca

SEQ ID NO: 517 - DNA, 432 bp, Artificial Sequence
  Description of Artificial Sequence: Synthetic polynucleotide
ggtaccccgggcagcggtaccgcatcttcctctccaggtagctctaccccgtctggtgctaccggttccccaggtagctctaccccgtctggtgcaaccggctccccaggtagcccggctggctctcctacctctactgaggaaggtacttctgaaagcgctactcctgagtctggtccaggtacctctactgaaccgtccgaaggtagcgctccaggttctagcccttctgcatccaccggtaccggcccaggttctagcccgtctgcttctaccggtactggtccaggtgcttctccgggtactagctctactggttctccaggtacctctaccgaaccgtccgagggtagcgcaccaggtacctctactgaaccgtctgagggtagcgctccaggtagcgaaccggcaacctccggttctgaaactcca

SEQ ID NO: 518 - protein, 144 aa, Artificial Sequence
  Description of Artificial Sequence: Synthetic polypeptide
GTPGSGTASSSPGSSTPSGATGSPGSSTPSGATGSPGSPAGSPTSTEEGTSESATPESGPGTSTEPSEGSAPGSSPSASTGTGPGSSPSASTGTGPGASPGTSSTGSPGTSTEPSEGSAPGTSTEPSEGSAPGSEPATSGSETP

SEQ ID NO: 519 - DNA, 432 bp, Artificial Sequence
  Description of Artificial Sequence: Synthetic polynucleotide
ggttctaccagcgaatccccttctggcactgcaccaggttctactagcgaatccccttctggtaccgcaccaggtacttctccgagcggcgaatcttctactgctccaggtacctctactgaaccttccgaaggcagcgctccaggtacctctaccgaaccgtccgagggcagcgcaccaggtacttctgaaagcgcaacccctgaatccggtccaggtgcatctcctggtaccagctctaccggttctccaggtagctctactccttctggtgctactggctctccaggtgcttccccgggtaccagctctaccggttctccaggttctactagcgaatctccttctggcactgcaccaggttctaccagcgaatctccgtctggcactgcaccaggtacctctacccctgaaagcggttccgcttctcca

SEQ ID NO: 520 - protein, 144 aa, Artificial Sequence
  Description of Artificial Sequence: Synthetic polypeptide
GSTSESPSGTAPGSTSESPSGTAPGTSPSGESSTAPGTSTEPSEGSAPGTSTEPSEGSAPGTSESATPESGPGASPGTSSTGSPGSSTPSGATGSPGASPGTSSTGSPGSTSESPSGTAPGSTSESPSGTAPGTSTPESGSASP

SEQ ID NO: 521 - DNA, 432 bp, Artificial Sequence
  Description of Artificial Sequence: Synthetic polynucleotide
ggtacttctaccgaaccttccgagggcagcgcaccaggtacttctgaaagcgctacccctgagtccggcccaggtacttctgaaagcgctactcctgaatccggtccaggtacctctactgaaccttctgagggcagcgctccaggtacttctgaaagcgctaccccggagtccggtccaggtacttctactgaaccgtccgaaggtagcgcaccaggtacttctactgaaccttccgaaggtagcgctccaggtagcgaacctgctacttctggttctgaaaccccaggtagcccggctggctctccgacctccaccgaggaaggtgcttctcctggcaccagctctactggttctccaggttctagcccttctgcttctaccggtactggtccaggttctagcccttctgcatccactggtactggtcca

SEQ ID NO: 522 - protein, 144 aa, Artificial Sequence
  Description of Artificial Sequence: Synthetic polypeptide
GTSTEPSEGSAPGTSESATPESGPGTSESATPESGPGTSTEPSEGSAPGTSESATPESGPGTSTEPSEGSAPGTSTEPSEGSAPGSEPATSGSETPGSPAGSPTSTEEGASPGTSSTGSPGSSPSASTGTGPGSSPSASTGTGP

SEQ ID NO: 523 - DNA, 432 bp, Artificial Sequence
  Description of Artificial Sequence: Synthetic polynucleotide
ggtagcgaaccggcaacctctggctctgaaaccccaggtacctctgaaagcgctactccggaatctggtccaggtacttctgaaagcgctactccggaatccggtccaggttctaccagcgaatctccttctggcaccgctccaggttctactagcgaatccccgtctggtaccgcaccaggtacttctcctagcggcgaatcttctaccgcaccaggtgcatctccgggtactagctctaccggttctccaggttctagcccttctgcttccactggtaccggcccaggtagctctaccccgtctggtgctactggttccccaggtagctctactccgtctggtgcaaccggttccccaggtagctctactccttctggtgctactggctccccaggtgcatcccctggcaccagctctaccggttctcca

SEQ ID NO: 524 - protein, 144 aa, Artificial Sequence
  Description of Artificial Sequence: Synthetic polypeptide
GSEPATSGSETPGTSESATPESGPGTSESATPESGPGSTSESPSGTAPGSTSESPSGTAPGTSPSGESSTAPGASPGTSSTGSPGSSPSASTGTGPGSSTPSGATGSPGSSTPSGATGSPGSSTPSGATGSPGASPGTSSTGSP

SEQ ID NO: 525 - DNA, 432 bp, Artificial Sequence
  Description of Artificial Sequence: Synthetic polynucleotide
ggtgcttctccgggcaccagctctactggttctccaggttctagcccttctgcatccaccggtaccggtccaggtagctctaccccttctggtgcaaccggctctccaggtacttctgaaagcgctaccccggaatctggcccaggtagcgaaccggctacttctggttctgaaaccccaggtagcgaaccggctacctccggttctgaaactccaggtacttctgaaagcgctactccggagtccggtccaggtacctctaccgaaccgtccgaaggcagcgctccaggtacttctactgaaccttctgagggtagcgctccaggtacctctaccgaaccgtccgagggtagcgcaccaggtacctctactgaaccgtctgagggtagcgctccaggtagcgaaccggcaacctccggttctgaaactcca

SEQ ID NO: 526 - protein, 144 aa, Artificial Sequence
  Description of Artificial Sequence: Synthetic polypeptide
GASPGTSSTGSPGSSPSASTGTGPGSSTPSGATGSPGTSESATPESGPGSEPATSGSETPGSEPATSGSETPGTSESATPESGPGTSTEPSEGSAPGTSTEPSEGSAPGTSTEPSEGSAPGTSTEPSEGSAPGSEPATSGSETP

SEQ ID NO: 527 - DNA, 432 bp, Artificial Sequence
  Description of Artificial Sequence: Synthetic polynucleotide
ggtacctctaccgaaccttccgaaggtagcgctccaggtagcccggcaggttctcctacttccactgaggaaggtacttctaccgaaccttctgagggtagcgcaccaggtacctctgaaagcgcaactcctgagtctggcccaggtagcgaacctgctacctccggctctgagactccaggtacctctgaaagcgcaaccccggaatctggtccaggtagcccggctggctctcctacctctactgaggaaggtacttctgaaagcgctactcctgagtctggtccaggtacctctactgaaccgtccgaaggtagcgctccaggtagcgaacctgctacttctggttctgaaactccaggtacttctaccgaaccgtccgagggtagcgctccaggtagcgaacctgctacttctggttctgaaactcca

SEQ ID NO: 528 - protein, 144 aa, Artificial Sequence
  Description of Artificial Sequence: Synthetic polypeptide
GTSTEPSEGSAPGSPAGSPTSTEEGTSTEPSEGSAPGTSESATPESGPGSEPATSGSETPGTSESATPESGPGSPAGSPTSTEEGTSESATPESGPGTSTEPSEGSAPGSEPATSGSETPGTSTEPSEGSAPGSEPATSGSETP

SEQ ID NO: 529 - DNA, 432 bp, Artificial Sequence
  Description of Artificial Sequence: Synthetic polynucleotide
ggtacttctaccgaaccgtccgaaggcagcgctccaggtacctctactgaaccttccgagggcagcgctccaggtacctctaccgaaccttctgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccttccgagggcagcgcaccaggtacttctgaaagcgctacccctgagtccggcccaggtacttctgaaagcgctactcctgaatccggtccaggtacttctactgaaccttccgaaggtagcgctccaggtagcgaacctgctacttctggttctgaaaccccaggtagcccggctggctctccgacctccaccgaggaa

SEQ ID NO: 530 - protein, 144 aa, Artificial Sequence
  Description of Artificial Sequence: Synthetic polypeptide
GTSTEPSEGSAPGTSTEPSEGSAPGTSTEPSEGSAPGTSTEPSEGSAPGTSTEPSEGSAPGTSTEPSEGSAPGTSTEPSEGSAPGTSESATPESGPGTSESATPESGPGTSTEPSEGSAPGSEPATSGSETPGSPAGSPTSTEE

SEQ ID NO: 531 - DNA, 432 bp, Artificial Sequence
  Description of Artificial Sequence: Synthetic polynucleotide
ggtacttctaccgaaccgtccgagggcagcgctccaggtacttctactgaaccttctgaaggcagcgctccaggtacttctactgaaccttccgaaggtagcgcaccaggttctaccagcgaatccccttctggtactgctccaggttctaccagcgaatccccttctggcaccgcaccaggtacttctacccctgaaagcggctccgcttctccaggtagcgaacctgcaacctctggctctgaaaccccaggtacctctgaaagcgctactcctgaatctggcccaggtacttctactgaaccgtccgagggcagcgcaccaggtacttctactgaaccgtctgaaggtagcgcaccaggtacttctgaaagcgcaaccccggaatccggcccaggtacctctgaaagcgcaaccccggagtccggccca

SEQ ID NO: 532 - protein, 144 aa, Artificial Sequence
  Description of Artificial Sequence: Synthetic polypeptide
GTSTEPSEGSAPGTSTEPSEGSAPGTSTEPSEGSAPGSTSESPSGTAPGSTSESPSGTAPGTSTPESGSASPGSEPATSGSETPGTSESATPESGPGTSTEPSEGSAPGTSTEPSEGSAPGTSESATPESGPGTSESATPESGP

SEQ ID NO: 533 - DNA, 432 bp, Artificial Sequence
  Description of Artificial Sequence: Synthetic polynucleotide
ggtagctctaccccttctggtgctaccggctctccaggttctagcccgtctgcttctaccggtaccggtccaggtagctctaccccttctggtgctactggttctccaggtagccctgctggctctccgacttctactgaggaaggtagcccggctggttctccgacttctactgaggaaggtacttctaccgaaccttccgaaggtagcgctccaggtgcttccccgggcactagctctaccggttctccaggttctagcccttctgcatctactggtactggcccaggtactccgggcagcggtactgcttcttcctctccaggttctactagctctactgctgaatctcctggcccaggtacttctcctagcggtgaatcttctaccgctccaggtacctctactccggaaagcggttctgcatctcca

SEQ ID NO: 534 - protein, 144 aa, Artificial Sequence
  Description of Artificial Sequence: Synthetic polypeptide
GSSTPSGATGSPGSSPSASTGTGPGSSTPSGATGSPGSPAGSPTSTEEGSPAGSPTSTEEGTSTEPSEGSAPGASPGTSSTGSPGSSPSASTGTGPGTPGSGTASSSPGSTSSTAESPGPGTSPSGESSTAPGTSTPESGSASP

SEQ ID NO: 535 - DNA, 432 bp, Artificial Sequence
  Description of Artificial Sequence: Synthetic polynucleotide
ggtacctctactgaaccttctgagggcagcgctccaggtacttctgaaagcgctaccccggagtccggtccaggtacttctactgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtactcctggcagcggtaccgcttcttcttctccaggtgcttctcctggtactagctctactggttctccaggtgcttctccgggcactagctctactggttctccaggtagccctgctggctctccgacttctactgaggaaggtagcccggctggttctccgacttctactgaggaaggtacttctaccgaaccttccgaaggtagcgctcca

SEQ ID NO: 536 - protein, 144 aa, Artificial Sequence
  Description of Artificial Sequence: Synthetic polypeptide
GTSTEPSEGSAPGTSESATPESGPGTSTEPSEGSAPGTSTEPSEGSAPGTSESATPESGPGTSESATPESGPGTPGSGTASSSPGASPGTSSTGSPGASPGTSSTGSPGSPAGSPTSTEEGSPAGSPTSTEEGTSTEPSEGSAP

SEQ ID NO: 537 - DNA, 432 bp, Artificial Sequence
  Description of Artificial Sequence: Synthetic polynucleotide
ggtagcccagcaggctctccgacttccactgaggaaggtacttctactgaaccttccgaaggcagcgcaccaggtacctctactgaaccttctgagggcagcgctccaggtacctctaccgaaccgtctgaaggtagcgcaccaggtacctctgaaagcgcaactcctgagtccggtccaggtacttctgaaagcgcaaccccggagtctggcccaggtaccccgggtagcggtactgcttcttcctctccaggtagctctaccccttctggtgcaaccggctctccaggtgcttctccgggcaccagctctaccggttctccaggtacctctactgaaccttctgagggcagcgctccaggtacttctgaaagcgctaccccggagtccggtccaggtacttctactgaaccgtccgaaggtagcgcacca

SEQ ID NO: 538 - protein, 144 aa, Artificial Sequence
  Description of Artificial Sequence: Synthetic polypeptide
GSPAGSPTSTEEGTSTEPSEGSAPGTSTEPSEGSAPGTSTEPSEGSAPGTSESATPESGPGTSESATPESGPGTPGSGTASSSPGSSTPSGATGSPGASPGTSSTGSPGTSTEPSEGSAPGTSESATPESGPGTSTEPSEGSAP

SEQ ID NO: 539 - DNA, 432 bp, Artificial Sequence
  Description of Artificial Sequence: Synthetic polynucleotide
ggtagcgaaccggcaacctccggctctgaaactccaggtacttctgaaagcgctactccggaatccggcccaggtagcgaaccggctacttccggctctgaaaccccaggtagctctaccccgtctggtgcaaccggctccccaggtactcctggtagcggtaccgcttcttcttctccaggtagctctactccgtctggtgctaccggctccccaggtgcatctcctggtaccagctctaccggttctccaggtagctctactccttctggtgctactggctctccaggtgcttccccgggtaccagctctaccggttctccaggtagcgaacctgctacttctggttctgaaactccaggtacttctaccgaaccgtccgagggtagcgctccaggtagcgaacctgctacttctggttctgaaactcca

SEQ ID NO: 540 - protein, 144 aa, Artificial Sequence
  Description of Artificial Sequence: Synthetic polypeptide
GSEPATSGSETPGTSESATPESGPGSEPATSGSETPGSSTPSGATGSPGTPGSGTASSSPGSSTPSGATGSPGASPGTSSTGSPGSSTPSGATGSPGASPGTSSTGSPGSEPATSGSETPGTSTEPSEGSAPGSEPATSGSETP

SEQ ID NO: 541 - DNA, 432 bp, Artificial Sequence
  Description of Artificial Sequence: Synthetic polynucleotide
ggtacctctactgaaccttccgaaggcagcgctccaggtacctctaccgaaccgtccgagggcagcgcaccaggtacttctgaaagcgcaacccctgaatccggtccaggtagccctgctggctctccgacttctactgaggaaggtagcccggctggttctccgacttctactgaggaaggtacttctaccgaaccttccgaaggtagcgctccaggtagcccggctggttctccgacttccaccgaggaaggtacctctactgaaccttctgagggtagcgctccaggtacctctactgaaccttccgaaggcagcgctccaggtgcttccccgggcaccagctctactggttctccaggttctagcccgtctgcttctactggtactggtccaggttctagcccttctgcttccactggtactggtcca

SEQ ID NO: 542 - protein, 144 aa, Artificial Sequence
  Description of Artificial Sequence: Synthetic polypeptide
GTSTEPSEGSAPGTSTEPSEGSAPGTSESATPESGPGSPAGSPTSTEEGSPAGSPTSTEEGTSTEPSEGSAPGSPAGSPTSTEEGTSTEPSEGSAPGTSTEPSEGSAPGASPGTSSTGSPGSSPSASTGTGPGSSPSASTGTGP

SEQ ID NO: 543 - DNA, 432 bp, Artificial Sequence
  Description of Artificial Sequence: Synthetic polynucleotide
ggtagctctaccccgtctggtgctaccggttccccaggtgcttctcctggtactagctctaccggttctccaggtagctctaccccgtctggtgctactggctctccaggtagccctgctggctctccaacctccaccgaagaaggtacctctgaaagcgcaacccctgaatccggcccaggtagcgaaccggcaacctccggttctgaaaccccaggtgcatctcctggtactagctctactggttctccaggtagctctactccgtctggtgcaaccggctctccaggttctagcccttctgcatctaccggtactggtccaggttctaccagcgaatccccttctggtactgctccaggttctaccagcgaatccccttctggcaccgcaccaggtacttctacccctgaaagcggctccgcttctcca

SEQ ID NO: 544 - protein, 144 aa, Artificial Sequence
  Description of Artificial Sequence: Synthetic polypeptide
GSSTPSGATGSPGASPGTSSTGSPGSSTPSGATGSPGSPAGSPTSTEEGTSESATPESGPGSEPATSGSETPGASPGTSSTGSPGSSTPSGATGSPGSSPSASTGTGPGSTSESPSGTAPGSTSESPSGTAPGTSTPESGSASP

SEQ ID NO: 545 - DNA, 432 bp, Artificial Sequence
  Description of Artificial Sequence: Synthetic polynucleotide
ggttctaccagcgaatctccttctggcaccgctccaggttctactagcgaatccccgtctggtaccgcaccaggtacttctcctagcggcgaatcttctaccgcaccaggtacctctgaaagcgctactccggagtctggcccaggtacctctactgaaccgtctgagggtagcgctccaggtacttctactgaaccgtccgaaggtagcgcaccaggtacctctactgaaccttctgagggcagcgctccaggtacttctgaaagcgctaccccggagtccggtccaggtacttctactgaaccgtccgaaggtagcgcaccaggtagctctaccccgtctggtgctaccggttccccaggtgcttctcctggtactagctctaccggttctccaggtagctctaccccgtctggtgctactggctctcca

SEQ ID NO: 546 - protein, 144 aa, Artificial Sequence
  Description of Artificial Sequence: Synthetic polypeptide
GSTSESPSGTAPGSTSESPSGTAPGTSPSGESSTAPGTSESATPESGPGTSTEPSEGSAPGTSTEPSEGSAPGTSTEPSEGSAPGTSESATPESGPGTSTEPSEGSAPGSSTPSGATGSPGASPGTSSTGSPGSSTPSGATGSP

SEQ ID NO: 547 - DNA, 432 bp, Artificial Sequence
  Description of Artificial Sequence: Synthetic polynucleotide
ggttctactagctctactgcagaatctccgggcccaggtacctctcctagcggtgaatcttctaccgctccaggtacttctccgagcggtgaatcttctaccgctccaggttctactagctctaccgctgaatctccgggtccaggttctaccagctctactgcagaatctcctggcccaggtacttctactccggaaagcggttccgcttctccaggtacttctcctagcggtgaatcttctaccgctccaggttctaccagctctactgctgaatctcctggcccaggtacttctaccccggaaagcggctccgcttctccaggttctaccagctctaccgctgaatctcctggcccaggttctactagcgaatctccgtctggcaccgcaccaggtacttcccctagcggtgaatcttctactgcacca

SEQ ID NO: 548 - protein, 144 aa, Artificial Sequence
  Description of Artificial Sequence: Synthetic polypeptide
GSTSSTAESPGPGTSPSGESSTAPGTSPSGESSTAPGSTSSTAESPGPGSTSSTAESPGPGTSTPESGSASPGTSPSGESSTAPGSTSSTAESPGPGTSTPESGSASPGSTSSTAESPGPGSTSESPSGTAPGTSPSGESSTAP

SEQ ID NO: 549 - DNA, 432 bp, Artificial Sequence
  Description of Artificial Sequence: Synthetic polynucleotide
ggtacctctactccggaaagcggttccgcatctccaggttctaccagcgaatccccgtctggcaccgcaccaggttctactagctctactgctgaatctccgggcccaggtacctctactgaaccttccgaaggcagcgctccaggtacctctaccgaaccgtccgagggcagcgcaccaggtacttctgaaagcgcaacccctgaatccggtccaggtacctctgaaagcgctactccggagtctggcccaggtacctctactgaaccgtctgagggtagcgctccaggtacttctactgaaccgtccgaaggtagcgcaccaggtacttctgaaagcgctactccggagtccggtccaggtacctctaccgaaccgtccgaaggcagcgctccaggtacttctactgaaccttctgagggtagcgctccc

SEQ ID NO: 550 - protein, 144 aa, Artificial Sequence
  Description of Artificial Sequence: Synthetic polypeptide
GTSTPESGSASPGSTSESPSGTAPGSTSSTAESPGPGTSTEPSEGSAPGTSTEPSEGSAPGTSESATPESGPGTSESATPESGPGTSTEPSEGSAPGTSTEPSEGSAPGTSESATPESGPGTSTEPSEGSAPGTSTEPSEGSAP

SEQ ID NO: 551 - DNA, 432 bp, Artificial Sequence
  Description of Artificial Sequence: Synthetic polynucleotide
ggtacctctaccgaaccgtccgagggtagcgcaccaggtacctctactgaaccgtctgagggtagcgctccaggtagcgaaccggcaacctccggttctgaaactccaggtacttctactgaaccgtctgaaggtagcgcaccaggtacttctgaaagcgcaaccccggaatccggcccaggtacctctgaaagcgcaaccccggagtccggcccaggtgcatctccgggtactagctctaccggttctccaggttctagcccttctgcttccactggtaccggcccaggtagctctaccccgtctggtgctactggttccccaggtagctctactccgtctggtgcaaccggttccccaggtagctctactccttctggtgctactggctccccaggtgcatcccctggcaccagctctaccggttctcca

SEQ ID NO: 552 - protein, 144 aa, Artificial Sequence
  Description of Artificial Sequence: Synthetic polypeptide
GTSTEPSEGSAPGTSTEPSEGSAPGSEPATSGSETPGTSTEPSEGSAPGTSESATPESGPGTSESATPESGPGASPGTSSTGSPGSSPSASTGTGPGSSTPSGATGSPGSSTPSGATGSPGSSTPSGATGSPGASPGTSSTGSP

SEQ ID NO: 553 - DNA, 432 bp, Artificial Sequence
  Description of Artificial Sequence: Synthetic polynucleotide
ggtagcgaaccggcaacctctggctctgaaactccaggtagcgaacctgcaacctccggctctgaaaccccaggtacttctactgaaccttctgagggcagcgcaccaggtagcgaacctgcaacctctggctctgaaaccccaggtacctctgaaagcgctactcctgaatctggcccaggtacttctactgaaccgtccgagggcagcgcaccaggtagctctactccgtctggtgctaccggctctccaggtagctctaccccttctggtgcaaccggctccccaggtgcttctccgggtaccagctctactggttctccaggtagctctaccccgtctggtgctaccggttccccaggtgcttctcctggtactagctctaccggttctccaggtagctctaccccgtctggtgctactggctctcca

SEQ ID NO: 554 - protein, 144 aa, Artificial Sequence
  Description of Artificial Sequence: Synthetic polypeptide
GSEPATSGSETPGSEPATSGSETPGTSTEPSEGSAPGSEPATSGSETPGTSESATPESGPGTSTEPSEGSAPGSSTPSGATGSPGSSTPSGATGSPGASPGTSSTGSPGSSTPSGATGSPGASPGTSSTGSPGSSTPSGATGSP

SEQ ID NO: 555 - DNA, 432 bp, Artificial Sequence
  Description of Artificial Sequence: Synthetic polynucleotide
ggtacttctaccgaaccgtccgagggcagcgctccaggtacttctactgaaccttctgaaggcagcgctccaggtacttctactgaaccttccgaaggtagcgcaccaggtacttctgaaagcgctactccggagtccggtccaggtacctctaccgaaccgtccgaaggcagcgctccaggtacttctactgaaccttctgagggtagcgctccaggttctactagcgaatctccgtctggcactgctccaggtacttctcctagcggtgaatcttctaccgctccaggtacttcccctagcggcgaatcttctaccgctccaggtagcccggctggctctcctacctctactgaggaaggtacttctgaaagcgctactcctgagtctggtccaggtacctctactgaaccgtccgaaggtagcgctcca

SEQ ID NO: 556 - protein, 144 aa, Artificial Sequence
  Description of Artificial Sequence: Synthetic polypeptide
GTSTEPSEGSAPGTSTEPSEGSAPGTSTEPSEGSAPGTSESATPESGPGTSTEPSEGSAPGTSTEPSEGSAPGSTSESPSGTAPGTSPSGESSTAPGTSPSGESSTAPGSPAGSPTSTEEGTSESATPESGPGTSTEPSEGSAP

SEQ ID NO: 557 - DNA, 432 bp, Artificial Sequence
  Description of Artificial Sequence: Synthetic polynucleotide
ggtacttctactgaaccttccgaaggtagcgctccaggtagcgaacctgctacttctggttctgaaaccccaggtagcccggctggctctccgacctccaccgaggaaggtagcccggcaggctctccgacctctactgaggaaggtacttctgaaagcgcaaccccggagtccggcccaggtacctctaccgaaccgtctgagggcagcgcaccaggtacctctactgaaccttccgaaggcagcgctccaggtacctctaccgaaccgtccgagggcagcgcaccaggtacttctgaaagcgcaacccctgaatccggtccaggtagctctactccgtctggtgcaaccggctccccaggttctagcccgtctgcttccactggtactggcccaggtgcttccccgggcaccagctctactggttctcca

SEQ ID NO: 558 - protein, 144 aa, Artificial Sequence
  Description of Artificial Sequence: Synthetic polypeptide
GTSTEPSEGSAPGSEPATSGSETPGSPAGSPTSTEEGSPAGSPTSTEEGTSESATPESGPGTSTEPSEGSAPGTSTEPSEGSAPGTSTEPSEGSAPGTSESATPESGPGSSTPSGATGSPGSSPSASTGTGPGASPGTSSTGSP

SEQ ID NO: 559 - DNA, 432 bp, Artificial Sequence
  Description of Artificial Sequence: Synthetic polynucleotide
ggtagcgaaccggctacttccggctctgagactccaggtagccctgctggctctccgacctctaccgaagaaggtacctctgaaagcgctacccctgagtctggcccaggtacctctactgaaccttccgaaggcagcgctccaggtacctctaccgaaccgtccgagggcagcgcaccaggtacttctgaaagcgcaacccctgaatccggtccaggtacctctactccggaaagcggttccgcatctccaggttctaccagcgaatccccgtctggcaccgcaccaggttctactagctctactgctgaatctccgggcccaggtacttctgaaagcgctactccggagtccggtccaggtacctctaccgaaccgtccgaaggcagcgctccaggtacttctactgaaccttctgagggtagcgctcca

SEQ ID NO: 560 - protein, 144 aa, Artificial Sequence
  Description of Artificial Sequence: Synthetic polypeptide
GSEPATSGSETPGSPAGSPTSTEEGTSESATPESGPGTSTEPSEGSAPGTSTEPSEGSAPGTSESATPESGPGTSTPESGSASPGSTSESPSGTAPGSTSSTAESPGPGTSESATPESGPGTSTEPSEGSAPGTSTEPSEGSAP

SEQ ID NO: 561 - DNA, 432 bp, Artificial Sequence
  Description of Artificial Sequence: Synthetic polynucleotide
ggtacttctaccgaaccgtccgagggcagcgctccaggtacttctactgaaccttctgaaggcagcgctccaggtacttctactgaaccttccgaaggtagcgcaccaggtacctctaccgaaccgtctgaaggtagcgcaccaggtacctctgaaagcgcaactcctgagtccggtccaggtacttctgaaagcgcaaccccggagtctggcccaggtactcctggcagcggtaccgcatcttcctctccaggtagctctactccgtctggtgcaactggttccccaggtgcttctccgggtaccagctctaccggttctccaggttccaccagctctactgctgaatctcctggtccaggtacctctcctagcggtgaatcttctactgctccaggtacttctactcctgaaagcggctctgcttctcca

SEQ ID NO: 562 - protein, 144 aa, Artificial Sequence
  Description of Artificial Sequence: Synthetic polypeptide
GTSTEPSEGSAPGTSTEPSEGSAPGTSTEPSEGSAPGTSTEPSEGSAPGTSESATPESGPGTSESATPESGPGTPGSGTASSSPGSSTPSGATGSPGASPGTSSTGSPGSTSSTAESPGPGTSPSGESSTAPGTSTPESGSASP

SEQ ID NO: 563 - DNA, 432 bp, Artificial Sequence
  Description of Artificial Sequence: Synthetic polynucleotide
ggtagcccggcaggctctccgacctctactgaggaaggtacttctgaaagcgcaaccccggagtccggcccaggtacctctaccgaaccgtctgagggcagcgcaccaggtacttctgaaagcgcaacccctgaatccggtccaggtagcgaaccggctacttctggctctgagactccaggtacttctaccgaaccgtccgaaggtagcgcaccaggtagcccggctggttctccgacttccaccgaggaaggtacctctactgaaccttctgagggtagcgctccaggtacctctactgaaccttccgaaggcagcgctccaggtacttctaccgaaccgtccgagggcagcgctccaggtacttctactgaaccttctgaaggcagcgctccaggtacttctactgaaccttccgaaggtagcgcacca

SEQ ID NO: 564 - protein, 144 aa, Artificial Sequence
  Description of Artificial Sequence: Synthetic polypeptide
GSPAGSPTSTEEGTSESATPESGPGTSTEPSEGSAPGTSESATPESGPGSEPATSGSETPGTSTEPSEGSAPGSPAGSPTSTEEGTSTEPSEGSAPGTSTEPSEGSAPGTSTEPSEGSAPGTSTEPSEGSAPGTSTEPSEGSAP

SEQ ID NO: 565 - DNA, 432 bp, Artificial Sequence
  Description of Artificial Sequence: Synthetic polynucleotide
ggtacttctccgagcggtgaatcttctaccgcaccaggttctactagctctaccgctgaatctccgggcccaggtacttctccgagcggtgaatcttctactgctccaggtacctctgaaagcgctactccggagtctggcccaggtacctctactgaaccgtctgagggtagcgctccaggtacttctactgaaccgtccgaaggtagcgcaccaggttctagcccttctgcatctactggtactggcccaggtagctctactccttctggtgctaccggctctccaggtgcttctccgggtactagctctaccggttctccaggtacttctactccggaaagcggttccgcatctccaggtacttctcctagcggtgaatcttctactgctccaggtacctctcctagcggcgaatcttctactgctcca

SEQ ID NO: 566 - protein, 144 aa, Artificial Sequence
  Description of Artificial Sequence: Synthetic polypeptide
GTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAP

SEQ ID NO: 567 - DNA, 432 bp, Artificial Sequence
  Description of Artificial Sequence: Synthetic polynucleotide
ggtacctctgaaagcgctactccggagtctggcccaggtacctctactgaaccgtctgagggtagcgctccaggtacttctactgaaccgtccgaaggtagcgcaccaggtagccctgctggctctccgacttctactgaggaaggtagcccggctggttctccgacttctactgaggaaggtacttctaccgaaccttccgaaggtagcgctccaggttctagcccttctgcttccaccggtactggcccaggtagctctaccccttctggtgctaccggctccccaggtagctctactccttctggtgcaactggctctccaggtagcgaaccggcaacttccggctctgaaaccccaggtacttctgaaagcgctactcctgagtctggcccaggtagcgaacctgctacctctggctctgaaacccca

SEQ ID NO: 568 - protein, 144 aa, Artificial Sequence
  Description of Artificial Sequence: Synthetic polypeptide
GTSESATPESGPGTSTEPSEGSAPGTSTEPSEGSAPGSPAGSPTSTEEGSPAGSPTSTEEGTSTEPSEGSAPGSSPSASTGTGPGSSTPSGATGSPGSSTPSGATGSPGSEPATSGSETPGTSESATPESGPGSEPATSGSETP

SEQ ID NO: 569 - DNA, 432 bp, Artificial Sequence
  Description of Artificial Sequence: Synthetic polynucleotide
ggtacttctaccgaaccgtccgaaggcagcgctccaggtacctctactgaaccttccgagggcagcgctccaggtacctctaccgaaccttctgaaggtagcgcaccaggtagctctaccccgtctggtgctaccggttccccaggtgcttctcctggtactagctctaccggttctccaggtagctctaccccgtctggtgctactggctctccaggtacttctgaaagcgcaacccctgaatccggtccaggtagcgaaccggctacttctggctctgagactccaggtacttctaccgaaccgtccgaaggtagcgcaccaggttctactagcgaatctccttctggcactgcaccaggttctaccagcgaatctccgtctggcactgcaccaggtacctctacccctgaaagcggttccgcttctcca

SEQ ID NO: 570 - protein, 144 aa, Artificial Sequence
  Description of Artificial Sequence: Synthetic polypeptide
GTSTEPSEGSAPGTSTEPSEGSAPGTSTEPSEGSAPGSSTPSGATGSPGASPGTSSTGSPGSSTPSGATGSPGTSESATPESGPGSEPATSGSETPGTSTEPSEGSAPGSTSESPSGTAPGSTSESPSGTAPGTSTPESGSASP

SEQ ID NO: 571 - DNA, 432 bp, Artificial Sequence
  Description of Artificial Sequence: Synthetic polynucleotide
ggtacctctactcctgaaagcggttctgcatctccaggttccactagctctaccgcagaatctccgggcccaggttctactagctctactgctgaatctcctggcccaggttctagcccttctgcatctactggtactggcccaggtagctctactccttctggtgctaccggctctccaggtgcttctccgggtactagctctaccggttctccaggtagcgaaccggcaacctccggctctgaaaccccaggtacctctgaaagcgctactcctgaatccggcccaggtagcccggcaggttctccgacttccactgaggaaggttctactagcgaatctccttctggcactgcaccaggttctaccagcgaatctccgtctggcactgcaccaggtacctctacccctgaaagcggttccgcttctccc

SEQ ID NO: 572 - protein, 144 aa, Artificial Sequence
  Description of Artificial Sequence: Synthetic polypeptide
GTSTPESGSASPGSTSSTAESPGPGSTSSTAESPGPGSSPSASTGTGPGSSTPSGATGSPGASPGTSSTGSPGSEPATSGSETPGTSESATPESGPGSPAGSPTSTEEGSTSESPSGTAPGSTSESPSGTAPGTSTPESGSASP

SEQ ID NO: 573 - DNA, 432 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctccaggttctaccagcgaatctccttctggcaccgctccaggttctactagcgaatccccgtctggtaccgcaccaggtacttctcctagcggcgaatcttctaccgcaccaggtacctctaccgaaccttccgaaggtagcgctccaggtagcccggcaggttctcctacttccactgaggaaggtacttctaccgaaccttctgagggtagcgcaccaggtagcgaacctgcaacctctggctctgaaaccccaggtacctctgaaagcgctactcctgaatctggcccaggtacttctactgaaccgtccgagggcagcgcacca

SEQ ID NO: 574 - protein, 144 aa, Artificial Sequence
  Description of Artificial Sequence: Synthetic polypeptide
GSPAGSPTSTEEGTSESATPESGPGTSTEPSEGSAPGSTSESPSGTAPGSTSESPSGTAPGTSPSGESSTAPGTSTEPSEGSAPGSPAGSPTSTEEGTSTEPSEGSAPGSEPATSGSETPGTSESATPESGPGTSTEPSEGSAP

SEQ ID NO: 575 - DNA, 432 bp, Artificial Sequence
  Description of Artificial Sequence: Synthetic polynucleotide
ggtacctctaccgaaccttccgaaggtagcgctccaggtagcccggcaggttctcctacttccactgaggaaggtacttctaccgaaccttctgagggtagcgcaccaggtacctcccctagcggcgaatcttctactgctccaggtacctctcctagcggcgaatcttctaccgctccaggtacctcccctagcggtgaatcttctaccgcaccaggttctaccagcgaatccccttctggtactgctccaggttctaccagcgaatccccttctggcaccgcaccaggtacttctacccctgaaagcggctccgcttctccaggtagcgaacctgcaacctctggctctgaaaccccaggtacctctgaaagcgctactcctgaatctggcccaggtacttctactgaaccgtccgagggcagcgcacca

SEQ ID NO: 576 - protein, 144 aa, Artificial Sequence
  Description of Artificial Sequence: Synthetic polypeptide
GTSTEPSEGSAPGSPAGSPTSTEEGTSTEPSEGSAPGTSPSGESSTAPGTSPSGESSTAPGTSPSGESSTAPGSTSESPSGTAPGSTSESPSGTAPGTSTPESGSASPGSEPATSGSETPGTSESATPESGPGTSTEPSEGSAP

SEQ ID NO: 577 - DNA, 432 bp, Artificial Sequence
  Description of Artificial Sequence: Synthetic polynucleotide
ggtagcgaaccggcaacctctggctctgaaaccccaggtacctctgaaagcgctactccggaatctggtccaggtacttctgaaagcgctactccggaatccggtccaggtacttctccgagcggtgaatcttctaccgcaccaggttctactagctctaccgctgaatctccgggcccaggtacttctccgagcggtgaatcttctactgctccaggttctactagcgaatccccgtctggtactgctccaggtacttcccctagcggtgaatcttctactgctccaggttctaccagctctaccgcagaatctccgggtccaggtagctctactccgtctggtgcaaccggttccccaggtagctctaccccttctggtgcaaccggctccccaggtagctctaccccttctggtgcaaactggctctcc

SEQ ID NO: 578 - protein, 144 aa, Artificial Sequence
  Description of Artificial Sequence: Synthetic polypeptide
GSEPATSGSETPGTSESATPESGPGTSESATPESGPGTSPSGESSTAPGSTSSTAESPGPGTSPSGESSTAPGSTSESPSGTAPGTSPSGESSTAPGSTSSTAESPGPGSSTPSGATGSPGSSTPSGATGSPGSSTPSGANWLS

SEQ ID NO: 579 - DNA, 432 bp, Artificial Sequence
  Description of Artificial Sequence: Synthetic polynucleotide
ggtagccctgctggctctccgacttctactgaggaaggtagcccggctggttctccgacttctactgaggaaggtacttctaccgaaccttccgaaggtagcgctccaggtacctctactgaaccttccgaaggcagcgctccaggtacctctaccgaaccgtccgagggcagcgcaccaggtacttctgaaagcgcaacccctgaatccggtccaggtgcatctcctggtaccagctctaccggttctccaggtagctctactccttctggtgctactggctctccaggtgcttccccgggtaccagctctaccggttctccaggtagctctaccccgtctggtgctactggttctccaggtactccgggcagcggtactgcttcttcctctccaggtagctctaccccttctggtgctactggctctcca

SEQ ID NO: 580 - protein, 144 aa, Artificial Sequence
  Description of Artificial Sequence: Synthetic polypeptide
GSPAGSPTSTEEGSPAGSPTSTEEGTSTEPSEGSAPGTSTEPSEGSAPGTSTEPSEGSAPGTSESATPESGPGASPGTSSTGSPGSSTPSGATGSPGASPGTSSTGSPGSSTPSGATGSPGTPGSGTASSSPGSSTPSGATGSP

SEQ ID NO: 581 - DNA, 432 bp, Artificial Sequence
  Description of Artificial Sequence: Synthetic polynucleotide
ggtagctctaccccgtctggtgctactggttctccaggtactccgggcagcggtactgcttcttcctctccaggtagctctaccccttctggtgctactggctctccaggtagcccggctggctctcctacctctactgaggaaggtacttctgaaagcgctactcctgagtctggtccaggtacctctactgaaccgtccgaaggtagcgctccaggtacctctgaaagcgcaactcctgagtctggcccaggtagcgaacctgctacctccggctctgagactccaggtacctctgaaagcgcaaccccggaatctggtccaggtacttctactgaaccgtctgaaggtagcgcaccaggtacttctgaaagcgcaaccccggaatccggcccaggtacctctgaaagcgcaaccccggagtccggccca

SEQ ID NO: 582 - protein, 144 aa, Artificial Sequence
  Description of Artificial Sequence: Synthetic polypeptide
GSSTPSGATGSPGTPGSGTASSSPGSSTPSGATGSPGSPAGSPTSTEEGTSESATPESGPGTSTEPSEGSAPGTSESATPESGPGSEPATSGSETPGTSESATPESGPGTSTEPSEGSAPGTSESATPESGPGTSESATPESGP

SEQ ID NO: 583 - DNA, 57 bp, Artificial Sequence
  Description of Artificial Sequence: Synthetic oligonucleotide
aggtgcaagcgcaagcggcgcgccaagcacgggaggttcgtcttcactcgagggtac

SEQ ID NO: 584 - DNA, 49 bp, Artificial Sequence
  Description of Artificial Sequence: Synthetic oligonucleotide
cctcgagtgaagacgaacctcccgtgcttggcgcgccgcttgcgcttgc

SEQ ID NO: 585 - protein, 11 aa, Artificial Sequence
  Description of Artificial Sequence: Synthetic peptide
GASASGAPSTG

SEQ ID NO: 586 - DNA, 57 bp, Artificial Sequence
  Description of Artificial Sequence: Synthetic oligonucleotide
aggtccagaaccaacggggccggccccaagcggaggttcgtcttcactcgagggtac

SEQ ID NO: 587 - DNA, 49 bp, Artificial Sequence
  Description of Artificial Sequence: Synthetic oligonucleotide
cctcgagtgaagacgaacctccgcttggggccggccccgttggttctgg

SEQ ID NO: 588 - protein, 11 aa, Artificial Sequence
  Description of Artificial Sequence: Synthetic peptide
GPEPTGPAPSG

SEQ ID NO: 589 - protein, 13 aa, Artificial Sequence
  Description of Artificial Sequence: Synthetic peptide
MASPAGSPTSTEE

SEQ ID NO: 590 - protein, 13 aa, Artificial Sequence
  Description of Artificial Sequence: Synthetic peptide
MATSESATPESGP

SEQ ID NO: 591 - protein, 13 aa, Artificial Sequence
  Description of Artificial Sequence: Synthetic peptide
MATSPSGESSTAP

SEQ ID NO: 592 - protein, 13 aa, Artificial Sequence
  Description of Artificial Sequence: Synthetic peptide
MESTSSTAESPGP

SEQ ID NO: 593 - protein, 13 aa, Artificial Sequence
  Description of Artificial Sequence: Synthetic peptide
MASSTPSGATGSP

SEQ ID NO: 594 - protein, 13 aa, Artificial Sequence
  Description of Artificial Sequence: Synthetic peptide
MEASPGTSSTGSP

SEQ ID NO: 595 - protein, 11 aa, Artificial Sequence
  Description of Artificial Sequence: Synthetic peptide
MASTPESGSSG

SEQ ID NO: 596 - DNA, 51 bp, Artificial Sequence
  Description of Artificial Sequence: Synthetic oligonucleotide
atggctagtccggctggctctccgacctccactgaggaaggtacttctact

SEQ ID NO: 597 - DNA, 51 bp, Artificial Sequence
  Description of Artificial Sequence: Synthetic oligonucleotide
atggctagtcctgctggctctccaacctccactgaggaaggtacttctact

SEQ ID NO: 598 - DNA, 51 bp, Artificial Sequence
  Description of Artificial Sequence: Synthetic oligonucleotide
atggctagtccagcaggctctcctacctccaccgaggaaggtacttctact

SEQ ID NO: 599 - DNA, 51 bp, Artificial Sequence
  Description of Artificial Sequence: Synthetic oligonucleotide
atggctagtcctgctggctctccgacctctactgaggaaggtacttctact

SEQ ID NO: 600 - DNA, 51 bp, Artificial Sequence
  Description of Artificial Sequence: Synthetic oligonucleotide
atggctacatccgaaagcgcaacccctgagtccggtccaggtacttctact

SEQ ID NO: 601 - DNA, 51 bp, Artificial Sequence
  Description of Artificial Sequence: Synthetic oligonucleotide
atggctacatccgaaagcgcaacccctgaatctggtccaggtacttctact

SEQ ID NO: 602 - DNA, 51 bp, Artificial Sequence
  Description of Artificial Sequence: Synthetic oligonucleotide
atggctacgtctgaaagcgctactccggaatctggtccaggtacttctact

SEQ ID NO: 603 - DNA, 51 bp, Artificial Sequence
  Description of Artificial Sequence: Synthetic oligonucleotide
atggctacgtccgaaagcgctacccctgaatccggtccaggtacttctact

SEQ ID NO: 604 - DNA, 51 bp, Artificial Sequence
  Description of Artificial Sequence: Synthetic oligonucleotide
atggctagttctaccccgtctggtgcaaccggttccccaggtacttctact

SEQ ID NO: 605 - DNA, 51 bp, Artificial Sequence
  Description of Artificial Sequence: Synthetic oligonucleotide
atggctagctccactccgtctggtgctaccggttccccaggtacttctact

SEQ ID NO: 606 - DNA, 51 bp, Artificial Sequence
  Description of Artificial Sequence: Synthetic oligonucleotide
atggctagctctactccgtctggtgctactggttccccaggtacttctact

SEQ ID NO: 607 - DNA, 51 bp, Artificial Sequence
  Description of Artificial Sequence: Synthetic oligonucleotide
atggctagttctaccccttctggtgctactggttctccaggtacttctact

SEQ ID NO: 608 - DNA, 180 bp, Artificial Sequence
  Description of Artificial Sequence: Synthetic polynucleotide
atggctagtcctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgca

SEQ ID NO: 609 - DNA, 180 bp, Artificial Sequence; identical to SEQ ID NO: 608
  Description of Artificial Sequence: Synthetic polynucleotide

SEQ ID NO: 610 - DNA, 180 bp, Artificial Sequence
  Description of Artificial Sequence: Synthetic polynucleotide
atggctagtcctgctggctctccaacctccactgaggaaggtacttctaccgaaccgtccgagggtagcgcaccaggtagcccagcaggttctcctacctccaccgaggaaggtacttctaccgaaccgtccgagggtagcgcaccaggtacttctactgaaccgtctgaaggcagcgca

SEQ ID NO: 611 - DNA, 180 bp, Artificial Sequence
  Description of Artificial Sequence: Synthetic polynucleotide
atggctagtcctgctggctctccgacctctactgaggaaggtacttctactgaaccgtctgaaggcagcgcaccaggtagcgaaccggctacttccggttctgaaaccccaggtagcccagcaggttctccaacttctactgaagaaggtacttctactgaaccgtctgaaggcagcgca

SEQ ID NO: 612 - DNA, 180 bp, Artificial Sequence
  Description of Artificial Sequence: Synthetic polynucleotide
atggctagtcctgctggctctccaacctccactgaggaaggtaccccgggtagcggtactgcttcttcctctccaggtagctctaccccttctggtgcaaccggctctccaggtgcttctccgggcaccagctctaccggttctccaggtacttctactgaaccgtctgaaggcagcgca

SEQ ID NO: 613 - DNA, 180 bp, Artificial Sequence; identical to SEQ ID NO: 611
  Description of Artificial Sequence: Synthetic polynucleotide

SEQ ID NO: 614 - DNA, 180 bp, Artificial Sequence
  Description of Artificial Sequence: Synthetic polynucleotide
atggctagtcctgctggctctccgacctctactgaggaaggtacctcccctagcggcgaatcttctactgctccaggtacctctcctagcggcgaatcttctaccgctccaggtacctcccctagcggtgaatcttctaccgcaccaggtacttctactgaaccgtctgaaggcagcgca

SEQ ID NO: 615 - DNA, 180 bp, Artificial Sequence
  Description of Artificial Sequence: Synthetic polynucleotide
atggctagtcctgctggctctccgacctctactgaggaaggtacctctactccggaaagcggttccgcatctccaggttctaccagcgaatccccgtctggcaccgcaccaggttctactagctctactgctgaatctccgggcccaggtacttctactgaaccgtctgaaggcagcgca

SEQ ID NO: 616 - DNA, 180 bp, Artificial Sequence; identical to SEQ ID NO: 614
  Description of Artificial Sequence: Synthetic polynucleotide

SEQ ID NO: 617 - DNA, 180 bp, Artificial Sequence; identical to SEQ ID NO: 615
  Description of Artificial Sequence: Synthetic polynucleotide

SEQ ID NO: 618 - DNA, 180 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgca

SEQ ID NO: 619 - DNA, 180 bp, Artificial Sequence
  Description of Artificial Sequence: Synthetic polynucleotide
atggctgaacctgctggctctccgacctctactgaggaaggtacctcccctagcggcgaatcttctactgctccaggtacctctcctagcggcgaatcttctaccgctccaggtacctcccctagcggtgaatcttctaccgcaccaggtacttctactgaaccgtctgaaggcagcgca

SEQ ID NO: 620 - DNA, 180 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgag

SEQ ID NO: 621 - DNA, 180 bp, Artificial Sequence
  Description of Artificial Sequence: Synthetic polynucleotide
atggctgaaactgctggctctccaacctccactgaggaaggtgcatccccgggcaccagctctaccggttctccaggtagctctaccccgtctggtgctaccggctctccaggtagctctaccccgtctggtgctactggctctccaggtagcccggctggctctcctacctctactgag

SEQ ID NO: 622 - protein, 288 aa, Artificial Sequence
  Description of Artificial Sequence: Synthetic polypeptide
GEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGE

SEQ ID NO: 623 - protein, 7 aa, Artificial Sequence
  Description of Artificial Sequence: Synthetic peptide
ENLYFQG

SEQ ID NO: 624 - protein, 12 aa, Artificial Sequence
  Description of Artificial Sequence: Synthetic peptide
GSTSESPSGTAP

SEQ ID NO: 625 - protein, 12 aa, Artificial Sequence
  Description of Artificial Sequence: Synthetic peptide
GTSTPESGSASP

SEQ ID NO: 626 - protein, 12 aa, Artificial Sequence
  Description of Artificial Sequence: Synthetic peptide
GTSPSGESSTAP

SEQ ID NO: 627 - protein, 12 aa, Artificial Sequence
  Description of Artificial Sequence: Synthetic peptide
GSTSSTAESPGP

SEQ ID NO: 628 - protein, 24 aa, Artificial Sequence
  Description of Artificial Sequence: Synthetic peptide
GSPAGSPTSTEEGTSESATPESGP

SEQ ID NO: 629 - protein, 36 aa, Artificial Sequence; identical to SEQ ID NO: 239
  Description of Artificial Sequence: Synthetic polypeptide

SEQ ID NO: 630 - protein, 48 aa, Artificial Sequence
  Description of Artificial Sequence: Synthetic polypeptide
GSPAGSPTSTEEGTSESATPESGPGTSTEPSEGSAPGSPAGSPTSTEE

SEQ ID NO: 631 - protein, 60 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAP

SEQ ID NO: 632 - protein, 108 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETP

SEQ ID NO: 633 - protein, 216 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAP

SEQ ID NO: 634 - protein, 432 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAP

SEQ ID NO: 635 - protein, 864 aa, Artificial Sequence; identical to SEQ ID NO: 71
  Description of Artificial Sequence: Synthetic polypeptide

SEQ ID NO: 636 - protein, 576 aa, Artificial Sequence; identical to SEQ ID NO: 66
  Description of Artificial Sequence: Synthetic polypeptide

SEQ ID NO: 637 - protein, 576 aa, Artificial Sequence; identical to SEQ ID NO: 67
  Description of Artificial Sequence: Synthetic polypeptide

SEQ ID NO: 638 - protein, 540 aa, Artificial Sequence; identical to SEQ ID NO: 65
  Description of Artificial Sequence: Synthetic polypeptide

SEQ ID NO: 639 - protein, 504 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSP

SEQ ID NO: 640 - protein, 864 aa, Artificial Sequence; identical to SEQ ID NO: 71
  Description of Artificial Sequence: Synthetic polypeptide

SEQ ID NO: 641 - protein, 875 aa, Artificial Sequence; identical to SEQ ID NO: 72
  Description of Artificial Sequence: Synthetic polypeptide
  MOD_RES (430)..(432): Any amino acid
  MOD_RES (443)..(446): Any amino acid

SEQ ID NO: 642 - protein, 868 aa, Artificial Sequence
  Description of Artificial Sequence: Synthetic polypeptide
GGSPGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 643 - protein, 875 aa, Artificial Sequence; identical to SEQ ID NO: 74
  Description of Artificial Sequence: Synthetic polypeptide

SEQ ID NO: 644 - protein, 1318 aa, Artificial Sequence; identical to SEQ ID NO: 77
  Description of Artificial Sequence: Synthetic polypeptide

SEQ ID NO: 645 - protein, 924 aa, Artificial Sequence; identical to SEQ ID NO: 76
  Description of Artificial Sequence: Synthetic polypeptide

SEQ ID NO: 646 - protein, 913 aa, Artificial Sequence; identical to SEQ ID NO: 75
  Description of Artificial Sequence: Synthetic polypeptide

SEQ ID NO: 647 - protein, 864 aa, Artificial Sequence; identical to SEQ ID NO: 78
  Description of Artificial Sequence: Synthetic polypeptide

SEQ ID NO: 648 - protein, 84 aa, Artificial Sequence
  Description of Artificial Sequence: Synthetic polypeptide
ASPAAPAPASPAAPAPSAPAAAPASPAPAAPSAPAPAAPSAASPAAPSAPPAAASPAAPSAPPAASAAAPAAASAAASAPSAAA

SEQ ID NO: 649 - protein, 4 aa, Artificial Sequence
  Description of Artificial Sequence: Synthetic peptide
GGSG

SEQ ID NO: 650 - protein, 288 aa, Artificial Sequence
  Description of Artificial Sequence: Synthetic polypeptide
GSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEG

SEQ ID NO: 651 - protein, 288 aa, Artificial Sequence
  Description of Artificial Sequence: Synthetic polypeptide
GEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEG

SEQ ID NO: 652 - protein, 288 aa, Artificial Sequence
  Description of Artificial Sequence: Synthetic polypeptide
SSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSES

SEQ ID NO: 653 - protein, 288 aa, Artificial Sequence
  Description of Artificial Sequence: Synthetic polypeptide
GEGSGEGSEGEGSEGSGEGEGSEGSGEGEGGSEGSEGEGGSEGSEGEGGSEGSEGEGSGEGSEGEGGSEGSEGEGSGEGSEGEGSEGGSEGEGGSEGSEGEGSGEGSEGEGGEGGSEGEGSEGSGEGEGSGEGSEGEGSEGSGEGEGSGEGSEGEGSEGSGEGEGSEGSGEGEGGSEGSEGEGSEGSGEGEGGEGSGEGEGSGEGSEGEGGGEGSEGEGSGEGGEGEGSEGGSEGEGGSEGGEGEGSEGSGEGEGSEGGSEGEGSEGGSEGEGSEGSGEGEGSEGSGE

SEQ ID NO: 654 - protein, 576 aa, Artificial Sequence
  Description of Artificial Sequence: Synthetic polypeptide
GGKPGEGGKPEGGGGKPGGKPEGEGEGKPGGKPEGGGKPGGGEGGKPEGGKPEGEGKPGGGEGKPGGKPEGGGGKPEGEGKPGGGGGKPGGKPEGEGKPGGGEGGKPEGKPGEGGEGKPGGKPEGGGEGKPGGGKPGEGGKPGEGKPGGGEGGKPEGGKPEGEGKPGGGEGKPGGKPGEGGKPEGGGEGKPGGKPGEGGEGKPGGGKPEGEGKPGGGKPGGGEGGKPEGEGKPGGKPEGGGEGKPGGKPEGGGKPEGGGEGKPGGGKPGEGGKPGEGEGKPGGKPEGEGKPGGEGGGKPEGKPGGGEGGKPEGGKPGEGGKPEGGKPGEGGEGKPGGGKPGEGGKPEGGGKPEGEGKPGGGGKPGEGGKPEGGKPEGGGEGKPGGGKPEGEGKPGGGEGKPGGKPEGGGGKPGEGGKPEGGKPGGEGGGKPEGEGKPGGKPGEGGGGKPGGKPEGEGKPGEGGEGKPGGKPEGGGEGKPGGKPEGGGEGKPGGGKPGEGGKPEGGGKPGEGGKPGEGGKPEGEGKPGGGEGKPGGKPGEGGKPEGGGEGKPGGKPGGEGGGKPEGGKPGEGGKPEG

SEQ ID NO: 655 - protein, 558 aa, Artificial Sequence
  Description of Artificial Sequence: Synthetic polypeptide
GEGKPGGKPGSGGGKPGEGGKPGSGEGKPGGKPGSGGSGKPGGKPGEGGKPEGGSGGKPGGGGKPGGKPGGEGSGKPGGKPEGGGKPEGGSGGKPGGKPEGGSGGKPGGKPGSGEGGKPGGGKPGGEGKPGSGKPGGEGSGKPGGKPEGGSGGKPGGKPEGGSGGKPGGSGKPGGKPGEGGKPEGGSGGKPGGSGKPGGKPEGGGSGKPGGKPGEGGKPGSGEGGKPGGGKPGGEGKPGSGKPGGEGSGKPGGKPGSGGEGKPGGKPEGGSGGKPGGGKPGGEGKPGSGGKPGEGGKPGSGGGKPGGKPGGEGEGKPGGKPGEGGKPGGEGSGKPGGGGKPGGKPGGEGGKPEGSGKPGGGSGKPGGKPEGGGGKPEGSGKPGGGGKPEGSGKPGGGKPEGGSGGKPGGSGKPGGKPGEGGGKPEGSGKPGGGSGKPGGKPEGGGKPEGGSGGKPGGKPEGGSGGKPGGKPGGEGSGKPGGKPGSGEGGKPGGKPGEGSGGKPGGKPEGGSGGKPGGSGKPGGKPEGGGSGKPGGKPGEGGKPGGEGSGKPGGSGKPG

SEQ ID NO: 656 - protein, 577 aa, Artificial Sequence
  Description of Artificial Sequence: Synthetic polypeptide
GGSGKPGKPGGSGSGKPGSGKPGGGSGKPGSGKPGGGSGKPGSGKPGGGSGKPGSGKPGGGGKPGSGSGKPGGGKPGGSGGKPGGGSGKPGKPGSGGSGKPGSGKPGGGSGGKPGKPGSGGSGGKPGKPGSGGGSGKPGKPGSGGSGGKPGKPGSGGSGGKPGKPGSGGSGKPGSGKPGGGSGKPGSGKPGSGGSGKPGKPGSGGSGKPGSGKPGSGSGKPGSGKPGGGSGKPGSGKPGSGGSGKPGKPGSGGGKPGSGSGKPGGGKPGSGSGKPGGGKPGGSGGKPGGSGGKPGKPGSGGGSGKPGKPGSGGGSGKPGKPGGSGSGKPGSGKPGGGSGKPGSGKPGSGGSGKPGKPGSGGSGGKPGKPGSGGGKPGSGSGKPGGGKPGSGSGKPGGGKPGSGSGKPGGGKPGSGSGKPGGSGKPGSGKPGGGSGGKPGKPGSGGSGKPGSGKPGSGGSGKPGKPGGSGSGKPGSGKPGGGSGKPGSGKPGGGSGKPGSGKPGGGSGKPGSGKPGGGGKPGSGSGKPGGSGGKPGKPGSGGSGGKPGKPGSGGSGKPGSGKPGGGSGGKPGKPGSGG

SEQ ID NO: 657 - protein, 576 aa, Artificial Sequence
  Description of Artificial Sequence: Synthetic polypeptide
GEGSGEGSEGEGSEGSGEGEGSEGSGEGEGGSEGSEGEGSEGSGEGEGGEGSGEGEGSGEGSEGEGGGEGSEGEGSGEGGEGEGSEGGSEGEGGSEGGEGEGSEGSGEGEGSEGGSEGEGSEGGSEGEGSEGSGEGEGSEGSGEGEGSEGSGEGEGSEGSGEGEGSEGGSEGEGGSEGSEGEGSGEGSEGEGGSEGSEGEGGGEGSEGEGSGEGSEGEGGSEGSEGEGGSEGSEGEGGEGSGEGEGSEGSGEGEGSGEGSEGEGSEGSGEGEGSEGSGEGEGGSEGSEGEGSGEGSEGEGSEGSGEGEGSEGSGEGEGGSEGSEGEGGSEGSEGEGGSEGSEGEGGEGSGEGEGSEGSGEGEGSGEGSEGEGSEGSGEGEGSEGSGEGEGGSEGSEGEGSEGSGEGEGGEGSGEGEGSGEGSEGEGGGEGSEGEGSEGSGEGEGSEGSGEGEGSEGGSEGEGGSEGSEGEGSEGGSEGEGSEGGSEGEGSEGSGEGEGSEGSGEGEGSGEGSEGEGGSEGGEGEGSEGGSEGEGSEGGSEGEGGEGSGEGEGGGEGSEGEGSEGSGEGEGSGEGSE

SEQ ID NO: 658 - protein, 576 aa, Artificial Sequence; identical to SEQ ID NO: 66
  Description of Artificial Sequence: Synthetic polypeptide

SEQ ID NO: 659 - protein, 577 aa, Artificial Sequence
  Description of Artificial Sequence: Synthetic polypeptide
AGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 660 - protein, 540 aa, Artificial Sequence; identical to SEQ ID NO: 65
  Description of Artificial Sequence: Synthetic polypeptide

SEQ ID NO: 661 - protein, 504 aa, Artificial Sequence; identical to SEQ ID NO: 639
  Description of Artificial Sequence: Synthetic polypeptide

SEQ ID NO: 662 - protein, 816 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAP

SEQ ID NO: 663 - protein, 875 aa, Artificial Sequence; identical to SEQ ID NO: 72
  Description of Artificial Sequence: Synthetic polypeptide
  MOD_RES (430)..(432): Any amino acid
  MOD_RES (443)..(446): Any amino acid

SEQ ID NO: 664 - protein, 868 aa, Artificial Sequence; identical to SEQ ID NO: 642
  Description of Artificial Sequence: Synthetic polypeptide

SEQ ID NO: 665 - protein, 875 aa, Artificial Sequence; identical to SEQ ID NO: 74
  Description of Artificial Sequence: Synthetic polypeptide

SEQ ID NO: 666 - protein, 1318 aa, Artificial Sequence; identical to SEQ ID NO: 77
  Description of Artificial Sequence: Synthetic polypeptide

SEQ ID NO: 667 - protein, 9 aa, Artificial Sequence
  Description of Artificial Sequence: Synthetic peptide
FDKLPRTSG

SEQ ID NO: 668 - protein, 7 aa, Artificial Sequence
  Description of Artificial Sequence: Synthetic peptide
FKLMVWY

SEQ ID NO: 669 - protein, 241 aa, Artificial Sequence
  Description of Artificial Sequence: Synthetic polypeptide
MAEPAGSPTSTEEGTPGSGTASSSPGSSTPSGATGSPGASPGTSSTGSPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 670 - DNA, 726 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaa

SEQ ID NO: 671 - protein, 241 aa, Artificial Sequence
  Description of Artificial Sequence: Synthetic polypeptide
MAEPAGSPTSTEEGASPGTSSTGSPGSSTPSGATGSPGSSTPSGATGSPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSDNAGQIFKQTYSKFDTNSHNDDALLKNYGLLYCFRKDMDKVETFLRIVQCRSVEGSCGF

SEQ ID NO: 672 - DNA, 726 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaa

SEQ ID NO: 673 - protein, 336 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 674 - DNA, 1011 bp, Artificial Sequence
  Description of Artificial Sequence: Synthetic polynucleotide
ggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaa

SEQ ID NO: 675 - protein, 480 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSDNAGQIFKQTYSKFDTNSHNDDALLKNYGLLYCFRKDMDKVETFLRIVQCRSVEGSCGF

SEQ ID NO: 676 - DNA, 1443 bp, Artificial Sequence
  Description of Artificial Sequence: Synthetic polynucleotide
ggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaa

SEQ ID NO: 677 - protein, 336 aa, Artificial Sequence
  Description of Artificial Sequence: Synthetic polypeptide
GTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 678 - DNA, 1011 bp, Artificial Sequence
  Description of Artificial Sequence: Synthetic polynucleotide
ggtacttctactccggaaagcggttccgcatctccaggtacttctcctagcggtgaatcttctactgctccaggtacctctcctagcggcgaatcttctactgctccaggttctaccagctctaccgctgaatctcctggcccaggttctaccagcgaatccccgtctggcaccgcaccaggttctactagctctaccgcagaatctccgggtccaggtacttcccctagcggtgaatcttctactgctccaggtacctctactccggaaagcggctccgcatctccaggttctactagctctactgctgaatctcctggtccaggtacctcccctagcggcgaatcttctactgctccaggtacctctcctagcggcgaatcttctaccgctccaggtacctcccctagcggtgaatcttctaccgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaa

SEQ ID NO: 679 - protein, 768 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSDNAGQIFKQTYSKFDTNSHNDDALLKNYGLLYCFRKDMDKVETFLRIVQCRSVEGSCGF

SEQ ID NO: 680 - DNA, 2307 bp, Artificial Sequence
  Description of Artificial Sequence: Synthetic polynucleotide
ggttcctctgaaagcggttcttccgaaggtggtccaggttcctctgaaagcggttcttctgagggtggtccaggtgaatctccgggtggctccagcggttccgagtcaggttctggtggcgaaccttccgagtctggtagctcaggtgaatctccgggtggttctagcggttccgagtcaggtgaatctccgggtggttccagcggttctgagtcaggttcctccgaaagcggttcttctgagggcggtccaggttcctccgaaagcggttcttccgagggcggtccaggttcttctgaaagcggttcttccgagggcggtccaggtgaatctcctggtggttccagcggttccgagtcaggtgaatctccaggtggctctagcggttccgagtcaggtgaatctcctggtggttctagcggttctgaatcaggttcctccgaaagcggttcttctgagggcggtccaggttcctccgaaagcggttcttccgagggcggtccaggttcttctgaaagcggttcttccgagggcggtccaggttcctctgaaagcggttcttctgagggcggtccaggttcttccgaaagcggttcttccgagggcggtccaggttcttccgaaagcggttcttctgaaggcggtccaggttctggtggcgaaccgtccgagtctggtagctcaggtgaatctccgggtggctctagcggttccgagtcaggtgaatctcctggtggttccagcggttccgagtcaggttccggtggcgaaccgtccgaatctggtagctcaggtagcgaaggttcttctggtccaggcgaatcttcaggttcctctgaaagcggttcttctgagggcggtccaggttccggtggcgaaccgtccgaatctggtagctcaggtagcgaaggttcttctggtccaggcgaatcttcaggttcctctgaaagcggttcttctgagggcggtccaggttccggtggcgaaccttccgaatctggtagctcaggtgaatctccgggtggttctagcggttctgagtcaggttctggtggtgaaccttccgagtctggtagctcaggttctggtggcgaaccatccgagtctggtagctcaggttcttccgaaagcggttcttccgaaggcggtccaggttctggtggtgaaccgtccgaatctggtagctcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggtgaatcttcaggtagcgaaggttcttctggtcctggtgaatcctcaggttccggtggcgaaccatctgaatctggtagctcaggttcctctgaaagcggttcttccgaaggtggtccaggttcctctgaaagcggttcttctgagggtggtccaggtgaatctccgggtggctccagcggttccgagtcaggttctggtggcgaaccatccgaatctggtagctcaggtagcgaaggttcttctggtcctggcgaatcttcaggtgaatctccaggtggctctagcggttccgaatcaggtagcgaaggttcttccggtcctggtgagtcttcaggtgaatctccaggtggctctagcggttccgagtcaggtagcgaaggttcttctggtcctggcgagtcctcaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaa

SEQ ID NO: 681 - protein, 768 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 682 - DNA, 2307 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaa

SEQ ID NO: 683 - protein, 768 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 684 - DNA, 2307 bp, Artificial Sequence
  Description of Artificial Sequence: Synthetic polynucleotide
ggttctactagctctaccgctgaatctcctggcccaggttccactagctctaccgcagaatctccgggcccaggttctactagcgaatccccttctggtaccgctccaggttctactagctctaccgctgaatctccgggtccaggttctaccagctctactgcagaatctcctggcccaggtacttctactccggaaagcggttccgcttctccaggttctaccagcgaatctccttctggcaccgctccaggtacctctcctagcggcgaatcttctaccgctccaggttctactagcgaatctccttctggcactgcaccaggttctaccagcgaatctccttctggcaccgctccaggtacctctcctagcggcgaatcttctaccgctccaggttctactagcgaatctccttctggcactgcaccaggttctaccagcgaatctccttctggcaccgctccaggtacctctcctagcggcgaatcttctaccgctccaggttctactagcgaatctccttctggcactgcaccaggttctactagcgaatctccttctggcactgcaccaggttctaccagcgaatctccgtctggcactgcaccaggtacctctacccctgaaagcggttccgcttctccaggttctactagcgaatctccttctggtaccgctccaggtacttctacccctgaaagcggctccgcttctccaggttccactagctctaccgctgaatctccgggtccaggttctactagctctactgcagaatctcctggcccaggtacctctactccggaaagcggctctgcatctccaggtacttctacccctgaaagcggttctgcatctccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggttctaccagcgaatccccgtctggtactgctccaggttctaccagcgaatctccttctggtactgcaccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctactagcgaatctccttctggcactgcaccaggttctaccagcgaatctccgtctggcactgcaccaggtacctctacccctgaaagcggttccgcttctccaggtacttctccgagcggtgaatcttctaccgcaccaggttctactagctctaccgctgaatctccgggcccaggtacttctccgagcggtgaatcttctactgctccaggttccactagctctactgctgaatctcctggcccaggtacttctactccggaaagcggttccgcttctccaggttctactagcgaatctccgtctggcaccgcaccaggttctactagctctactgcagaatctcctggcccaggtacctctactccggaaagcggctctgcatctccaggtacttctacccctgaaagcggttctgcatctccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaa

SEQ ID NO: 685 - protein, 817 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 686 - DNA, 2454 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaa

SEQ ID NO: 687 - protein, 1028 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSSGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 688 - DNA, 3087 bp, Artificial Sequence
  Description of Artificial Sequence: Synthetic polynucleotide
ggttcctctgaaagcggttcttccgaaggtggtccaggttcctctgaaagcggttcttctgagggtggtccaggtgaatctccgggtggctccagcggttccgagtcaggttctggtggcgaaccttccgagtctggtagctcaggtgaatctccgggtggttctagcggttccgagtcaggtgaatctccgggtggttccagcggttctgagtcaggttcctccgaaagcggttcttctgagggcggtccaggttcctccgaaagcggttcttccgagggcggtccaggttcttctgaaagcggttcttccgagggcggtccaggtgaatctcctggtggttccagcggttccgagtcaggtgaatctccaggtggctctagcggttccgagtcaggtgaatctcctggtggttctagcggttctgaatcaggttcctccgaaagcggttcttctgagggcggtccaggttcctccgaaagcggttcttccgagggcggtccaggttcttctgaaagcggttcttccgagggcggtccaggttcctctgaaagcggttcttctgagggcggtccaggttcttccgaaagcggttcttccgagggcggtccaggttcttccgaaagcggttcttctgaaggcggtccaggttctggtggcgaaccgtccgagtctggtagctcaggtgaatctccgggtggctctagcggttccgagtcaggtgaatctcctggtggttccagcggttccgagtcaggttccggtggcgaaccgtccgaatctggtagctcaggtagcgaaggttcttctggtccaggcgaatcttcaggttcctctgaaagcggttcttctgagggcggtccaggttccggtggcgaaccgtccgaatctggtagctcaggtagcgaaggttcttctggtccaggcgaatcttcaggttcctctgaaagcggttcttctgagggcggtccaggttccggtggcgaaccttccgaatctggtagctcaggtgaatctccgggtggttctagcggttctgagtcaggttctggtggtgaaccttccgagtctggtagctcaggttctggtggcgaaccatccgagtctggtagctcaggttcttccgaaagcggttcttccgaaggcggtccaggttctggtggtgaaccgtccgaatctggtagctcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggtgaatcttcaggtagcgaaggttcttctggtcctggtgaatcctcaggttccggtggcgaaccatctgaatctggtagctcaggttcctctgaaagcggttcttccgaaggtggtccaggttcctctgaaagcggttcttctgagggtggtccaggtgaatctccgggtggctccagcggttccgagtcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggttcctctgaaagcggttcttctgagggcggtccaggttctggtggcgaaccatctgaatctggtagctcaggtagcgaaggttcttccggtccgggtgaatcttcaggtagcgaaggttcttccggtccaggtgaatcttcaggtagcgaaggttcttctggtcctggtgaatcctcaggttccggtggcgaaccatctgaatctggtagctcaggttctggtggcgaaccatccgaatctggtagctcaggtgaatctccgggtggctccagcggttctgaatcaggtgaatctcctggtggctccagcggttctgagtcaggttctggtggcgaaccatccgaatctggtagctcaggtagcgaaggttcttctggtcctggcgaatcttcaggtgaatctccaggtggctctagcggttccgaatcaggttcctctgaaagcggttcttctgagggcggtccaggttcttccgaaagcggttcttccgagggcggtccaggttcttccgaaagcggttcttctgaaggcggtccaggttctggtggcgaaccgtccgaatctggtagctcaggttcctccgaaagcggttcttctgaaggtggtccaggtgaatctccaggtggttctagcggttctgaatcaggttctggtggcgaaccgtccgaatctggtagctcaggttcctccgaaagcggttcttctgaaggtggtccaggtgaatctccaggtggttctagcggttctgaatcaggttctggtggcgaaccgtccgaatctggtagctcaggtgaatctcctggtggttccagcggttccgagtcaggttctggtggcgaaccttccgaatctggtagctcaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaa

SEQ ID NO: 689 - protein, 1056 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 690 - DNA, 3171 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaa

SEQ ID NO: 691 - protein, 1067 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 692 - DNA, 3204 bp, Artificial Sequence
  Description of Artificial Sequence: Synthetic polynucleotide
  modified_base (1287)..(1298): a, c, t, g, unknown or other
  modified_base (1330)..(1337): a, c, t, g, unknown or other
ggttctaccagcgaatctccttctggcaccgctccaggtacctctcctagcggcgaatcttctaccgctccaggttctactagcgaatctccttctggcactgcaccaggttctactagcgaatccccgtctggtactgctccaggtacttctactcctgaaagcggttccgcttctccaggtacctctactccggaaagcggttctgcatctccaggttctaccagcgaatctccttctggcaccgctccaggttctactagcgaatccccgtctggtaccgcaccaggtacttctcctagcggcgaatcttctaccgcaccaggttctactagcgaatctccgtctggcactgctccaggtacttctcctagcggtgaatcttctaccgctccaggtacttcccctagcggcgaatcttctaccgctccaggttctactagctctactgcagaatctccgggcccaggtacctctcctagcggtgaatcttctaccgctccaggtacttctccgagcggtgaatcttctaccgctccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctaccagctctaccgcagaatctcctggtccaggtacctctactccggaaagcggctctgcatctccaggttctactagcgaatctccttctggcactgcaccaggtacttctccgagcggtgaatcttctaccgcaccaggttctactagctctaccgctgaatctccgggcccaggtacttctccgagcggtgaatcttctactgctccaggtacctctactcctgaaagcggttctgcatctccaggttccactagctctaccgcagaatctccgggcccaggttctactagctctactgctgaatctcctggcccaggttctactagctctactgctgaatctccgggtccaggttctaccagctctactgctgaatctcctggtccaggtacctccccgagcggtgaatcttctactgcaccaggttctactagcgaatctccttctggcactgcaccaggttctaccagcgaatctccgtctggcactgcaccaggtacctctacccctgaaagcggtccnnnnnnnnnnnntgcaagcgcaagcggcgcgccaagcacgggannnnnnnntagcgaatctccttctggtaccgctccaggttctaccagcgaatccccgtctggtactgctccaggttctaccagcgaatctccttctggtactgcaccaggttctactagcgaatctccttctggtaccgctccaggttctaccagcgaatccccgtctggtactgctccaggttctaccagcgaatctccttctggtactgcaccaggtacttctactccggaaagcggttccgcatctccaggtacttctcctagcggtgaatcttctactgctccaggtacctctcctagcggcgaatcttctactgctccaggttctaccagctctactgctgaatctccgggtccaggtacttccccgagcggtgaatcttctactgcaccaggtacttctactccggaaagcggttccgcttctccaggttctaccagcgaatctccttctggcaccgctccaggttctactagcgaatccccgtctggtaccgcaccaggtacttctcctagcggcgaatcttctaccgcaccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggtacttctacccctgaaagcggctccgcttctccaggttccactagctctaccgctgaatctccgggtccaggttctaccagcgaatctccttctggcaccgctccaggttctactagcgaatccccgtctggtaccgcaccaggtacttctcctagcggcgaatcttctaccgcaccaggttctaccagctctactgctgaatctccgggtccaggtacttccccgagcggtgaatcttctactgcaccaggtacttctactccggaaagcggttccgcttctccaggtacctcccctagcggcgaatcttctactgctccaggtacctctcctagcggcgaatcttctaccgctccaggtacctcccctagcggtgaatcttctaccgcaccaggttctactagctctactgctgaatctccgggtccaggttctaccagctctactgctgaatctcctggtccaggtacctccccgagcggtgaatcttctactgcaccaggttctagcccttctgcttccaccggtaccggcccaggtagctctactccgtctggtgcaactggctctccaggtagctctactccgtctggtgcaaccggctccccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaa

SEQ ID NO: 693 - protein, 1056 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 694 - DNA, 3171 bp, Artificial Sequence
  Description of Artificial Sequence: Synthetic polynucleotide
ggtgcttccccgggcaccagctctactggttctccaggttctagcccgtctgcttctactggtactggtccaggttctagcccttctgcttccactggtactggtccaggtaccccgggtagcggtaccgcttcttcttctccaggtagctctactccgtctggtgctaccggctctccaggttctaacccttctgcatccaccggtaccggcccaggtgcttctccgggcaccagctctactggttctccaggtaccccgggcagcggtaccgcatcttcttctccaggtagctctactccttctggtgcaactggttctccaggtactcctggcagcggtaccgcttcttcttctccaggtgcttctcctggtactagctctactggttctccaggtgcttctccgggcactagctctactggttctccaggtaccccgggtagcggtactgcttcttcctctccaggtagctctaccccttctggtgcaaccggctctccaggtgcttctccgggcaccagctctaccggttctccaggtaccccgggtagcggtaccgcttcttcttctccaggtagctctactccgtctggtgctaccggctctccaggttctaacccttctgcatccaccggtaccggcccaggttctagcccttctgcttccaccggtactggcccaggtagctctaccccttctggtgctaccggctccccaggtagctctactccttctggtgcaactggctctccaggtgcatctccgggcactagctctactggttctccaggtgcatcccctggcactagctctactggttctccaggtgcttctcctggtaccagctctactggttctccaggtactcctggcagcggtaccgcttcttcttctccaggtgcttctcctggtactagctctactggttctccaggtgcttctccgggcactagctctactggttctccaggtgcttccccgggcactagctctaccggttctccaggttctagcccttctgcatctactggtactggcccaggtactccgggcagcggtactgcttcttcctctccaggtgcatctccgggcactagctctactggttctccaggtgcatcccctggcactagctctactggttctccaggtgcttctcctggtaccagctctactggttctccaggtagctctactccgtctggtgcaaccggttccccaggtagctctactccttctggtgctactggctccccaggtgcatcccctggcaccagctctaccggttctccaggtaccccgggcagcggtaccgcatcttcctctccaggtagctctaccccgtctggtgctaccggttccccaggtagctctaccccgtctggtgcaaccggctccccaggtagctctactccgtctggtgcaaccggctccccaggttctagcccgtctgcttccactggtactggcccaggtgcttccccgggcaccagctctactggttctccaggtgcatccccgggtaccagctctaccggttctccaggtactcctggcagcggtactgcatcttcctctccaggtgcttctccgggcaccagctctactggttctccaggtgcatctccgggcactagctctactggttctccaggtgcatcccctggcactagctctactggttctccaggtgcttctcctggtaccagctctactggttctccaggtacccctggtagcggtactgcttcttcctctccaggtagctctactccgtctggtgctaccggttctccaggtaccccgggtagcggtaccgcatcttcttctccaggtagctctaccccgtctggtgctactggttctccaggtactccgggcagcggtactgcttcttcctctccaggtagctctaccccttctggtgctactggctctccaggtagctctaccccgtctggtgctactggctccccaggttctagcccttctgcatccaccggtaccggtccaggttctagcccgtctgcatctactggtactggtccaggtgcatccccgggcactagctctaccggttctccaggtactcctggtagcggtactgcttcttcttctccaggtagctctactccttctggtgctactggttctccaggttctagcccttctgcatccaccggtaccggcccaggttctagcccgtctgcttctaccggtactggtccaggtgcttctccgggtactagctctactggttctccaggtgcatctcctggtactagctctactggttctccaggtagctctactccgtctggtgcaaccggctctccaggttctagcccttctgcatctaccggtactggtccaggtgcatcccctggtaccagctctaccggttctccaggttctagcccttctgcttctaccggtaccggtccaggtacccctggcagcggtaccgcatcttcctctccaggtagctctactccgtctggtgcaaccggttccccaggtagctctactccttctggtgctactggctccccaggtgcatcccctggcaccagctctaccggttctccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaa

SEQ ID NO: 695 - protein, 1067 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 696 - DNA, 3204 bp, Artificial Sequence
  Description of Artificial Sequence: Synthetic polynucleotide
ggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaa

SEQ ID NO: 697 - protein, 1105 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 698 - DNA, 3318 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaa

SEQ ID NO: 699 - protein, 1116 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 700 - DNA, 3351 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaa

SEQ ID NO: 701 - protein, 1510 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 702 - DNA, 4533 bp, Artificial Sequence
  Description of Artificial Sequence: Synthetic polynucleotide
ggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtccagaaccaacggggccggccccaagcggaggtagcgaaccggcaacctccggctctgaaaccccaggtacctctgaaagcgctactcctgaatccggcccaggtagcccggcaggttctccgacttccactgaggaaggtacttctgaaagcgctactcctgagtccggcccaggtagcccggctggctctccgacttccaccgaggaaggtagcccggctggctctccaacttctactgaagaaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggttctaccagcgaatctccttctggcaccgctccaggttctactagcgaatccccgtctggtaccgcaccaggtacttctcctagcggcgaatcttctaccgcaccaggtacttctaccgaaccttccgagggcagcgcaccaggtacttctgaaagcgctacccctgagtccggcccaggtacttctgaaagcgctactcctgaatccggtccaggtagcgaaccggcaacctctggctctgaaaccccaggtacctctgaaagcgctactccggaatctggtccaggtacttctgaaagcgctactccggaatccggtccaggtacctctactgaaccttctgagggcagcgctccaggtacttctgaaagcgctaccccggagtccggtccaggtacttctactgaaccgtccgaaggtagcgcaccaggtacctcccctagcggcgaatcttctactgctccaggtacctctcctagcggcgaatcttctaccgctccaggtacctcccctagcggtgaatcttctaccgcaccaggtacttctaccgaaccgtccgagggtagcgcaccaggtagcccagcaggttctcctacctccaccgaggaaggtacttctaccgaaccgtccgagggtagcgcaccaggttctagcccttctgcttccaccggtaccggcccaggtagctctactccgtctggtgcaactggctctccaggtagctctactccgtctggtgcaaccggctccccaggtagctctaccccgtctggtgctaccggctctccaggtagctctaccccgtctggtgcaaccggctccccaggtgcatccccgggtactagctctaccggttctccaggtgcaagcgcaagcggcgcgccaagcacgggaggtacttctccgagcggtgaatcttctaccgcaccaggttctactagctctaccgctgaatctccgggcccaggtacttctccgagcggtgaatcttctactgctccaggtacctctgaaagcgctactccggagtctggcccaggtacctctactgaaccgtctgagggtagcgctccaggtacttctactgaaccgtccgaaggtagcgcaccaggttctagcccttctgcatctactggtactggcccaggtagctctactccttctggtgctaccggctctccaggtgcttctccgggtactagctctaccggttctccaggtacttctactccggaaagcggttccgcatctccaggtacttctcctagcggtgaatcttctactgctccaggtacctctcctagcggcgaatcttctactgctccaggtacttctgaaagcgcaacccctgaatccggtccaggtagcgaaccggctacttctggctctgagactccaggtacttctaccgaaccgtccgaaggtagcgcaccaggttctaccagcgaatccccttctggtactgctccaggttctaccagcgaatccccttctggcaccgcaccaggtacttctacccctgaaagcggctccgcttctccaggtagcccggcaggctctccgacctctactgaggaaggtacttctgaaagcgcaaccccggagtccggcccaggtacctctaccgaaccgtctgagggcagcgcaccaggtagccctgctggctctccaacctccaccgaagaaggtacctctgaaagcgcaacccctgaatccggcccaggtagcgaaccggcaacctccggttctgaaaccccaggtagctctaccccgtctggtgctaccggttccccaggtgcttctcctggtactagctctaccggttctccaggtagctctaccccgtctggtgctactggctctccaggttctactagcgaatccccgtctggtactgctccaggtacttcccctagcggtgaatcttctactgctccaggttctaccagctctaccgcagaatctccgggtccaggtagctctaccccttctggtgcaaccggctctccaggtgcatccccgggtaccagctctaccggttctccaggtactccgggtagcggtaccgcttcttcctctccaggtagccctgctggctctccgacttctactgaggaaggtagcccggctggttctccgacttctactgaggaaggtacttctaccgaaccttccgaaggtagcgctccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaa

SEQ ID NO: 703 - protein, 336 aa, Artificial Sequence
  Description of Artificial Sequence: Synthetic polypeptide
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 704 - DNA, 1011 bp, Artificial Sequence
  Description of Artificial Sequence: Synthetic polynucleotide
tttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 705 - protein, 480 aa, Artificial Sequence
  Description of Artificial Sequence: Synthetic polypeptide
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 706 - DNA, 1443 bp, Artificial Sequence
  Description of Artificial Sequence: Synthetic polynucleotide
tttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 707 - protein, 336 aa, Artificial Sequence
  Description of Artificial Sequence: Synthetic polypeptide
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAP

SEQ ID NO: 708 - DNA, 1011 bp, Artificial Sequence
  Description of Artificial Sequence: Synthetic polynucleotide
tttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggtacttctactccggaaagcggttccgcatctccaggtacttctcctagcggtgaatcttctactgctccaggtacctctcctagcggcgaatcttctactgctccaggttctaccagctctaccgctgaatctcctggcccaggttctaccagcgaatccccgtctggcaccgcaccaggttctactagctctaccgcagaatctccgggtccaggtacttcccctagcggtgaatcttctactgctccaggtacctctactccggaaagcggctccgcatctccaggttctactagctctactgctgaatctcctggtccaggtacctcccctagcggcgaatcttctactgctccaggtacctctcctagcggcgaatcttctaccgctccaggtacctcccctagcggtgaatcttctaccgcacca

SEQ ID NO: 709 - protein, 768 aa, Artificial Sequence
  Description of Artificial Sequence: Synthetic polypeptide
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESS

SEQ ID NO: 710 - DNA, 2307 bp, Artificial Sequence
  Description of Artificial Sequence: Synthetic polynucleotide
tttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggttcctctgaaagcggttcttccgaaggtggtccaggttcctctgaaagcggttcttctgagggtggtccaggtgaatctccgggtggctccagcggttccgagtcaggttctggtggcgaaccttccgagtctggtagctcaggtgaatctccgggtggttctagcggttccgagtcaggtgaatctccgggtggttccagcggttctgagtcaggttcctccgaaagcggttcttctgagggcggtccaggttcctccgaaagcggttcttccgagggcggtccaggttcttctgaaagcggttcttccgagggcggtccaggtgaatctcctggtggttccagcggttccgagtcaggtgaatctccaggtggctctagcggttccgagtcaggtgaatctcctggtggttctagcggttctgaatcaggttcctccgaaagcggttcttctgagggcggtccaggttcctccgaaagcggttcttccgagggcggtccaggttcttctgaaagcggttcttccgagggcggtccaggttcctctgaaagcggttcttctgagggcggtccaggttcttccgaaagcggttcttccgagggcggtccaggttcttccgaaagcggttcttctgaaggcggtccaggttctggtggcgaaccgtccgagtctggtagctcaggtgaatctccgggtggctctagcggttccgagtcaggtgaatctcctggtggttccagcggttccgagtcaggttccggtggcgaaccgtccgaatctggtagctcaggtagcgaaggttcttctggtccaggcgaatcttcaggttcctctgaaagcggttcttctgagggcggtccaggttccggtggcgaaccgtccgaatctggtagctcaggtagcgaaggttcttctggtccaggcgaatcttcaggttcctctgaaagcggttcttctgagggcggtccaggttccggtggcgaaccttccgaatctggtagctcaggtgaatctccgggtggttctagcggttctgagtcaggttctggtggtgaaccttccgagtctggtagctcaggttctggtggcgaaccatccgagtctggtagctcaggttcttccgaaagcggttcttccgaaggcggtccaggttctggtggtgaaccgtccgaatctggtagctcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggtgaatcttcaggtagcgaaggttcttctggtcctggtgaatcctcaggttccggtggcgaaccatctgaatctggtagctcaggttcctctgaaagcggttcttccgaaggtggtccaggttcctctgaaagcggttcttctgagggtggtccaggtgaatctccgggtggctccagcggttccgagtcaggttctggtggcgaaccatccgaatctggtagctcaggtagcgaaggttcttctggtcctggcgaatcttcaggtgaatctccaggtggctctagcggttccgaatcaggtagcgaaggttcttccggtcctggtgagtcttcaggtgaatctccaggtggctctagcggttccgagtcaggtagcgaaggttcttctggtcctggcgagtcctca

SEQ ID NO: 711 - protein, 768 aa, Artificial Sequence
  Description of Artificial Sequence: Synthetic polypeptide
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 712 - DNA, 2307 bp, Artificial Sequence
  Description of Artificial Sequence: Synthetic polynucleotide
tttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcacca

SEQ ID NO: 713 - protein, 768 aa, Artificial Sequence
  Description of Artificial Sequence: Synthetic polypeptide
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASP

SEQ ID NO: 714 - DNA, 2307 bp, Artificial Sequence
  Description of Artificial Sequence: Synthetic polynucleotide
tttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggttctactagctctaccgctgaatctcctggcccaggttccactagctctaccgcagaatctccgggcccaggttctactagcgaatccccttctggtaccgctccaggttctactagctctaccgctgaatctccgggtccaggttctaccagctctactgcagaatctcctggcccaggtacttctactccggaaagcggttccgcttctccaggttctaccagcgaatctccttctggcaccgctccaggtacctctcctagcggcgaatcttctaccgctccaggttctactagcgaatctccttctggcactgcaccaggttctaccagcgaatctccttctggcaccgctccaggtacctctcctagcggcgaatcttctaccgctccaggttctactagcgaatctccttctggcactgcaccaggttctaccagcgaatctccttctggcaccgctccaggtacctctcctagcggcgaatcttctaccgctccaggttctactagcgaatctccttctggcactgcaccaggttctactagcgaatctccttctggcactgcaccaggttctaccagcgaatctccgtctggcactgcaccaggtacctctacccctgaaagcggttccgcttctccaggttctactagcgaatctccttctggtaccgctccaggtacttctacccctgaaagcggctccgcttctccaggttccactagctctaccgctgaatctccgggtccaggttctactagctctactgcagaatctcctggcccaggtacctctactccggaaagcggctctgcatctccaggtacttctacccctgaaagcggttctgcatctccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggttctaccagcgaatccccgtctggtactgctccaggttctaccagcgaatctccttctggtactgcaccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctactagcgaatctccttctggcactgcaccaggttctaccagcgaatctccgtctggcactgcaccaggtacctctacccctgaaagcggttccgcttctccaggtacttctccgagcggtgaatcttctaccgcaccaggttctactagctctaccgctgaatctccgggcccaggtacttctccgagcggtgaatcttctactgctccaggttccactagctctactgctgaatctcctggcccaggtacttctactccggaaagcggttccgcttctccaggttctactagcgaatctccgtctggcaccgcaccaggttctactagctctactgcagaatctcctggcccaggtacctctactccggaaagcggctctgcatctccaggtacttctacccctgaaagcggttctgcatctcca

SEQ ID NO: 715 - protein, 817 aa, Artificial Sequence
  Description of Artificial Sequence: Synthetic polypeptide
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGMAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 716 - DNA, 2454 bp, Artificial Sequence
  Description of Artificial Sequence: Synthetic polynucleotide
tttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtatggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcacca

SEQ ID NO: 717 - protein, 1028 aa, Artificial Sequence
  Description of Artificial Sequence: Synthetic polypeptide
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSS

SEQ ID NO: 718 - DNA, 3087 bp, Artificial Sequence
  Description of Artificial Sequence: Synthetic polynucleotide
tttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggttcctctgaaagcggttcttccgaaggtggtccaggttcctctgaaagcggttcttctgagggtggtccaggtgaatctccgggtggctccagcggttccgagtcaggttctggtggcgaaccttccgagtctggtagctcaggtgaatctccgggtggttctagcggttccgagtcaggtgaatctccgggtggttccagcggttctgagtcaggttcctccgaaagcggttcttctgagggcggtccaggttcctccgaaagcggttcttccgagggcggtccaggttcttctgaaagcggttcttccgagggcggtccaggtgaatctcctggtggttccagcggttccgagtcaggtgaatctccaggtggctctagcggttccgagtcaggtgaatctcctggtggttctagcggttctgaatcaggttcctccgaaagcggttcttctgagggcggtccaggttcctccgaaagcggttcttccgagggcggtccaggttcttctgaaagcggttcttccgagggcggtccaggttcctctgaaagcggttcttctgagggcggtccaggttcttccgaaagcggttcttccgagggcggtccaggttcttccgaaagcggttcttctgaaggcggtccaggttctggtggcgaaccgtccgagtctggtagctcaggtgaatctccgggtggctctagcggttccgagtcaggtgaatctcctggtggttccagcggttccgagtcaggttccggtggcgaaccgtccgaatctggtagctcaggtagcgaaggttcttctggtccaggcgaatcttcaggttcctctgaaagcggttcttctgagggcggtccaggttccggtggcgaaccgtccgaatctggtagctcaggtagcgaaggttcttctggtccaggcgaatcttcaggttcctctgaaagcggttcttctgagggcggtccaggttccggtggcgaaccttccgaatctggtagctcaggtgaatctccgggtggttctagcggttctgagtcaggttctggtggtgaaccttccgagtctggtagctcaggttctggtggcgaaccatccgagtctggtagctcaggttcttccgaaagcggttcttccgaaggcggtccaggttctggtggtgaaccgtccgaatctggtagctcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggtgaatcttcaggtagcgaaggttcttctggtcctggtgaatcctcaggttccggtggcgaaccatctgaatctggtagctcaggttcctctgaaagcggttcttccgaaggtggtccaggttcctctgaaagcggttcttctgagggtggtccaggtgaatctccgggtggctccagcggttccgagtcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggttcctctgaaagcggttcttctgagggcggtccaggttctggtggcgaaccatctgaatctggtagctcaggtagcgaaggttcttccggtccgggtgaatcttcaggtagcgaaggttcttccggtccaggtgaatcttcaggtagcgaaggttcttctggtcctggtgaatcctcaggttccggtggcgaaccatctgaatctggtagctcaggttctggtggcgaaccatccgaatctggtagctcaggtgaatctccgggtggctccagcggttctgaatcaggtgaatctcctggtggctccagcggttctgagtcaggttctggtggcgaaccatccgaatctggtagctcaggtagcgaaggttcttctggtcctggcgaatcttcaggtgaatctccaggtggctctagcggttccgaatcaggttcctctgaaagcggttcttctgagggcggtccaggttcttccgaaagcggttcttccgagggcggtccaggttcttccgaaagcggttcttctgaaggcggtccaggttctggtggcgaaccgtccgaatctggtagctcaggttcctccgaaagcggttcttctgaaggtggtccaggtgaatctccaggtggttctagcggttctgaatcaggttctggtggcgaaccgtccgaatctggtagctcaggttcctccgaaagcggttcttctgaaggtggtccaggtgaatctccaggtggttctagcggttctgaatcaggttctggtggcgaaccgtccgaatctggtagctcaggtgaatctcctggtggttccagcggttccgagtcaggttctggtggcgaaccttccgaatctggtagctca

SEQ ID NO: 719 - protein, 1056 aa, Artificial Sequence
  Description of Artificial Sequence: Synthetic polypeptide
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 720 - DNA, 3171 bp, Artificial Sequence
  Description of Artificial Sequence: Synthetic polynucleotide
tttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 721 - protein, 1067 aa, Artificial Sequence
  Description of Artificial Sequence: Synthetic polypeptide
  MOD_RES (622)..(624): Any amino acid
  MOD_RES (635)..(638): Any amino acid
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 722 - DNA, 3204 bp, Artificial Sequence
  Description of Artificial Sequence: Synthetic polynucleotide
  modified_base (1866)..(1877): a, c, t, g, unknown or other
  modified_base (1909)..(1916): a, c, t, g, unknown or other
tttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggttctaccagcgaatctccttctggcaccgctccaggtacctctcctagcggcgaatcttctaccgctccaggttctactagcgaatctccttctggcactgcaccaggttctactagcgaatccccgtctggtactgctccaggtacttctactcctgaaagcggttccgcttctccaggtacctctactccggaaagcggttctgcatctccaggttctaccagcgaatctccttctggcaccgctccaggttctactagcgaatccccgtctggtaccgcaccaggtacttctcctagcggcgaatcttctaccgcaccaggttctactagcgaatctccgtctggcactgctccaggtacttctcctagcggtgaatcttctaccgctccaggtacttcccctagcggcgaatcttctaccgctccaggttctactagctctactgcagaatctccgggcccaggtacctctcctagcggtgaatcttctaccgctccaggtacttctccgagcggtgaatcttctaccgctccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctaccagctctaccgcagaatctcctggtccaggtacctctactccggaaagcggctctgcatctccaggttctactagcgaatctccttctggcactgcaccaggtacttctccgagcggtgaatcttctaccgcaccaggttctactagctctaccgctgaatctccgggcccaggtacttctccgagcggtgaatcttctactgctccaggtacctctactcctgaaagcggttctgcatctccaggttccactagctctaccgcagaatctccgggcccaggttctactagctctactgctgaatctcctggcccaggttctactagctctactgctgaatctccgggtccaggttctaccagctctactgctgaatctcctggtccaggtacctccccgagcggtgaatcttctactgcaccaggttctactagcgaatctccttctggcactgcaccaggttctaccagcgaatctccgtctggcactgcaccaggtacctctacccctgaaagcggtccnnnnnnnnnnnntgcaagcgcaagcggcgcgccaagcacgggannnnnnnntagcgaatctccttctggtaccgctccaggttctaccagcgaatccccgtctggtactgctccaggttctaccagcgaatctccttctggtactgcaccaggttctactagcgaatctccttctggtaccgctccaggttctaccagcgaatccccgtctggtactgctccaggttctaccagcgaatctccttctggtactgcaccaggtacttctactccggaaagcggttccgcatctccaggtacttctcctagcggtgaatcttctactgctccaggtacctctcctagcggcgaatcttctactgctccaggttctaccagctctactgctgaatctccgggtccaggtacttccccgagcggtgaatcttctactgcaccaggtacttctactccggaaagcggttccgcttctccaggttctaccagcgaatctccttctggcaccgctccaggttctactagcgaatccccgtctggtaccgcaccaggtacttctcctagcggcgaatcttctaccgcaccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggtacttctacccctgaaagcggctccgcttctccaggttccactagctctaccgctgaatctccgggtccaggttctaccagcgaatctccttctggcaccgctccaggttctactagcgaatccccgtctggtaccgcaccaggtacttctcctagcggcgaatcttctaccgcaccaggttctaccagctctactgctgaatctccgggtccaggtacttccccgagcggtgaatcttctactgcaccaggtacttctactccggaaagcggttccgcttctccaggtacctcccctagcggcgaatcttctactgctccaggtacctctcctagcggcgaatcttctaccgctccaggtacctcccctagcggtgaatcttctaccgcaccaggttctactagctctactgctgaatctccgggtccaggttctaccagctctactgctgaatctcctggtccaggtacctccccgagcggtgaatcttctactgcaccaggttctagcccttctgcttccaccggtaccggcccaggtagctctactccgtctggtgcaactggctctccaggtagctctactccgtctggtgcaaccggctcccca

SEQ ID NO: 723 - protein, 1056 aa, Artificial Sequence
  Description of Artificial Sequence: Synthetic polypeptide
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 724 - DNA, 3171 bp, Artificial Sequence
  Description of Artificial Sequence: Synthetic polynucleotide
tttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggtgcttccccgggcaccagctctactggttctccaggttctagcccgtctgcttctactggtactggtccaggttctagcccttctgcttccactggtactggtccaggtaccccgggtagcggtaccgcttcttcttctccaggtagctctactccgtctggtgctaccggctctccaggttctaacccttctgcatccaccggtaccggcccaggtgcttctccgggcaccagctctactggttctccaggtaccccgggcagcggtaccgcatcttcttctccaggtagctctactccttctggtgcaactggttctccaggtactcctggcagcggtaccgcttcttcttctccaggtgcttctcctggtactagctctactggttctccaggtgcttctccgggcactagctctactggttctccaggtaccccgggtagcggtactgcttcttcctctccaggtagctctaccccttctggtgcaaccggctctccaggtgcttctccgggcaccagctctaccggttctccaggtaccccgggtagcggtaccgcttcttcttctccaggtagctctactccgtctggtgctaccggctctccaggttctaacccttctgcatccaccggtaccggcccaggttctagcccttctgcttccaccggtactggcccaggtagctctaccccttctggtgctaccggctccccaggtagctctactccttctggtgcaactggctctccaggtgcatctccgggcactagctctactggttctccaggtgcatcccctggcactagctctactggttctccaggtgcttctcctggtaccagctctactggttctccaggtactcctggcagcggtaccgcttcttcttctccaggtgcttctcctggtactagctctactggttctccaggtgcttctccgggcactagctctactggttctccaggtgcttccccgggcactagctctaccggttctccaggttctagcccttctgcatctactggtactggcccaggtactccgggcagcggtactgcttcttcctctccaggtgcatctccgggcactagctctactggttctccaggtgcatcccctggcactagctctactggttctccaggtgcttctcctggtaccagctctactggttctccaggtagctctactccgtctggtgcaaccggttccccaggtagctctactccttctggtgctactggctccccaggtgcatcccctggcaccagctctaccggttctccaggtaccccgggcagcggtaccgcatcttcctctccaggtagctctaccccgtctggtgctaccggttccccaggtagctctaccccgtctggtgcaaccggctccccaggtagctctactccgtctggtgcaaccggctccccaggttctagcccgtctgcttccactggtactggcccaggtgcttccccgggcaccagctctactggttctccaggtgcatccccgggtaccagctctaccggttctccaggtactcctggcagcggtactgcatcttcctctccaggtgcttctccgggcaccagctctactggttctccaggtgcatctccgggcactagctctactggttctccaggtgcatcccctggcactagctctactggttctccaggtgcttctcctggtaccagctctactggttctccaggtacccctggtagcggtactgcttcttcctctccaggtagctctactccgtctggtgctaccggttctccaggtaccccgggtagcggtaccgcatcttcttctccaggtagctctaccccgtctggtgctactggttctccaggtactccgggcagcggtactgcttcttcctctccaggtagctctaccccttctggtgctactggctctccaggtagctctaccccgtctggtgctactggctccccaggttctagcccttctgcatccaccggtaccggtccaggttctagcccgtctgcatctactggtactggtccaggtgcatccccgggcactagctctaccggttctccaggtactcctggtagcggtactgcttcttcttctccaggtagctctactccttctggtgctactggttctccaggttctagcccttctgcatccaccggtaccggcccaggttctagcccgtctgcttctaccggtactggtccaggtgcttctccgggtactagctctactggttctccaggtgcatctcctggtactagctctactggttctccaggtagctctactccgtctggtgcaaccggctctccaggttctagcccttctgcatctaccggtactggtccaggtgcatcccctggtaccagctctaccggttctccaggttctagcccttctgcttctaccggtaccggtccaggtacccctggcagcggtaccgcatcttcctctccaggtagctctactccgtctggtgcaaccggttccccaggtagctctactccttctggtgctactggctccccaggtgcatcccctggcaccagctctaccggttctcca

SEQ ID NO: 725 - protein, 1067 aa, Artificial Sequence
  Description of Artificial Sequence: Synthetic polypeptide
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 726 - DNA, 3204 bp, Artificial Sequence
  Description of Artificial Sequence: Synthetic polynucleotide
tttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcacca

SEQ ID NO: 727 - protein, 1510 aa, Artificial Sequence
  Description of Artificial Sequence: Synthetic polypeptide
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 728 - DNA, 4533 bp, Artificial Sequence
  Description of Artificial Sequence: Synthetic polynucleotide
tttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtccagaaccaacggggccggccccaagcggaggtagcgaaccggcaacctccggctctgaaaccccaggtacctctgaaagcgctactcctgaatccggcccaggtagcccggcaggttctccgacttccactgaggaaggtacttctgaaagcgctactcctgagtccggcccaggtagcccggctggctctccgacttccaccgaggaaggtagcccggctggctctccaacttctactgaagaaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggttctaccagcgaatctccttctggcaccgctccaggttctactagcgaatccccgtctggtaccgcaccaggtacttctcctagcggcgaatcttctaccgcaccaggtacttctaccgaaccttccgagggcagcgcaccaggtacttctgaaagcgctacccctgagtccggcccaggtacttctgaaagcgctactcctgaatccggtccaggtagcgaaccggcaacctctggctctgaaaccccaggtacctctgaaagcgctactccggaatctggtccaggtacttctgaaagcgctactccggaatccggtccaggtacctctactgaaccttctgagggcagcgctccaggtacttctgaaagcgctaccccggagtccggtccaggtacttctactgaaccgtccgaaggtagcgcaccaggtacctcccctagcggcgaatcttctactgctccaggtacctctcctagcggcgaatcttctaccgctccaggtacctcccctagcggtgaatcttctaccgcaccaggtacttctaccgaaccgtccgagggtagcgcaccaggtagcccagcaggttctcctacctccaccgaggaaggtacttctaccgaaccgtccgagggtagcgcaccaggttctagcccttctgcttccaccggtaccggcccaggtagctctactccgtctggtgcaactggctctccaggtagctctactccgtctggtgcaaccggctccccaggtagctctaccccgtctggtgctaccggctctccaggtagctctaccccgtctggtgcaaccggctccccaggtgcatccccgggtactagctctaccggttctccaggtgcaagcgcaagcggcgcgccaagcacgggaggtacttctccgagcggtgaatcttctaccgcaccaggttctactagctctaccgctgaatctccgggcccaggtacttctccgagcggtgaatcttctactgctccaggtacctctgaaagcgctactccggagtctggcccaggtacctctactgaaccgtctgagggtagcgctccaggtacttctactgaaccgtccgaaggtagcgcaccaggttctagcccttctgcatctactggtactggcccaggtagctctactccttctggtgctaccggctctccaggtgcttctccgggtactagctctaccggttctccaggtacttctactccggaaagcggttccgcatctccaggtacttctcctagcggtgaatcttctactgctccaggtacctctcctagcggcgaatcttctactgctccaggtacttctgaaagcgcaacccctgaatccggtccaggtagcgaaccggctacttctggctctgagactccaggtacttctaccgaaccgtccgaaggtagcgcaccaggttctaccagcgaatccccttctggtactgctccaggttctaccagcgaatccccttctggcaccgcaccaggtacttctacccctgaaagcggctccgcttctccaggtagcccggcaggctctccgacctctactgaggaaggtacttctgaaagcgcaaccccggagtccggcccaggtacctctaccgaaccgtctgagggcagcgcaccaggtagccctgctggctctccaacctccaccgaagaaggtacctctgaaagcgcaacccctgaatccggcccaggtagcgaaccggcaacctccggttctgaaaccccaggtagctctaccccgtctggtgctaccggttccccaggtgcttctcctggtactagctctaccggttctccaggtagctctaccccgtctggtgctactggctctccaggttctactagcgaatccccgtctggtactgctccaggtacttcccctagcggtgaatcttctactgctccaggttctaccagctctaccgcagaatctccgggtccaggtagctctaccccttctggtgcaaccggctctccaggtgcatccccgggtaccagctctaccggttctccaggtactccgggtagcggtaccgcttcttcctctccaggtagccctgctggctctccgacttctactgaggaaggtagcccggctggttctccgacttctactgaggaaggtacttctaccgaaccttccgaaggtagcgctcca

SEQ ID NO: 729 - protein, 386 aa, Artificial Sequence
  Description of Artificial Sequence: Synthetic polypeptide
MAEPAGSPTSTEEGTPGSGTASSSPGSSTPSGATGSPGASPGTSSTGSPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 730 - DNA, 1161 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 731 - protein, 386 aa, Artificial Sequence
  Description of Artificial Sequence: Synthetic polypeptide
MAEPAGSPTSTEEGASPGTSSTGSPGSSTPSGATGSPGSSTPSGATGSPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 732 - DNA, 1161 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 733 - protein, 481 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 734 - DNA, 1446 bp, Artificial Sequence
  Description of Artificial Sequence: Synthetic polynucleotide
ggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 735 - protein, 625 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 736 - DNA, 1878 bp, Artificial Sequence
  Description of Artificial Sequence: Synthetic polynucleotide
ggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 737 - protein, 481 aa, Artificial Sequence
  Description of Artificial Sequence: Synthetic polypeptide
GTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 738 - DNA, 1446 bp, Artificial Sequence
  Description of Artificial Sequence: Synthetic polynucleotide
ggtacttctactccggaaagcggttccgcatctccaggtacttctcctagcggtgaatcttctactgctccaggtacctctcctagcggcgaatcttctactgctccaggttctaccagctctaccgctgaatctcctggcccaggttctaccagcgaatccccgtctggcaccgcaccaggttctactagctctaccgcagaatctccgggtccaggtacttcccctagcggtgaatcttctactgctccaggtacctctactccggaaagcggctccgcatctccaggttctactagctctactgctgaatctcctggtccaggtacctcccctagcggcgaatcttctactgctccaggtacctctcctagcggcgaatcttctaccgctccaggtacctcccctagcggtgaatcttctaccgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 739 - protein, 913 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 740 - DNA, 2742 bp, Artificial Sequence
  Description of Artificial Sequence: Synthetic polynucleotide
ggttcctctgaaagcggttcttccgaaggtggtccaggttcctctgaaagcggttcttctgagggtggtccaggtgaatctccgggtggctccagcggttccgagtcaggttctggtggcgaaccttccgagtctggtagctcaggtgaatctccgggtggttctagcggttccgagtcaggtgaatctccgggtggttccagcggttctgagtcaggttcctccgaaagcggttcttctgagggcggtccaggttcctccgaaagcggttcttccgagggcggtccaggttcttctgaaagcggttcttccgagggcggtccaggtgaatctcctggtggttccagcggttccgagtcaggtgaatctccaggtggctctagcggttccgagtcaggtgaatctcctggtggttctagcggttctgaatcaggttcctccgaaagcggttcttctgagggcggtccaggttcctccgaaagcggttcttccgagggcggtccaggttcttctgaaagcggttcttccgagggcggtccaggttcctctgaaagcggttcttctgagggcggtccaggttcttccgaaagcggttcttccgagggcggtccaggttcttccgaaagcggttcttctgaaggcggtccaggttctggtggcgaaccgtccgagtctggtagctcaggtgaatctccgggtggctctagcggttccgagtcaggtgaatctcctggtggttccagcggttccgagtcaggttccggtggcgaaccgtccgaatctggtagctcaggtagcgaaggttcttctggtccaggcgaatcttcaggttcctctgaaagcggttcttctgagggcggtccaggttccggtggcgaaccgtccgaatctggtagctcaggtagcgaaggttcttctggtccaggcgaatcttcaggttcctctgaaagcggttcttctgagggcggtccaggttccggtggcgaaccttccgaatctggtagctcaggtgaatctccgggtggttctagcggttctgagtcaggttctggtggtgaaccttccgagtctggtagctcaggttctggtggcgaaccatccgagtctggtagctcaggttcttccgaaagcggttcttccgaaggcggtccaggttctggtggtgaaccgtccgaatctggtagctcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggtgaatcttcaggtagcgaaggttcttctggtcctggtgaatcctcaggttccggtggcgaaccatctgaatctggtagctcaggttcctctgaaagcggttcttccgaaggtggtccaggttcctctgaaagcggttcttctgagggtggtccaggtgaatctccgggtggctccagcggttccgagtcaggttctggtggcgaaccatccgaatctggtagctcaggtagcgaaggttcttctggtcctggcgaatcttcaggtgaatctccaggtggctctagcggttccgaatcaggtagcgaaggttcttccggtcctggtgagtcttcaggtgaatctccaggtggctctagcggttccgagtcaggtagcgaaggttcttctggtcctggcgagtcctcaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 741 - protein, 913 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 742 - DNA, 2742 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 743 - protein, 913 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 744 - DNA, 2742 bp, Artificial Sequence
  Description of Artificial Sequence: Synthetic polynucleotide
ggttctactagctctaccgctgaatctcctggcccaggttccactagctctaccgcagaatctccgggcccaggttctactagcgaatccccttctggtaccgctccaggttctactagctctaccgctgaatctccgggtccaggttctaccagctctactgcagaatctcctggcccaggtacttctactccggaaagcggttccgcttctccaggttctaccagcgaatctccttctggcaccgctccaggtacctctcctagcggcgaatcttctaccgctccaggttctactagcgaatctccttctggcactgcaccaggttctaccagcgaatctccttctggcaccgctccaggtacctctcctagcggcgaatcttctaccgctccaggttctactagcgaatctccttctggcactgcaccaggttctaccagcgaatctccttctggcaccgctccaggtacctctcctagcggcgaatcttctaccgctccaggttctactagcgaatctccttctggcactgcaccaggttctactagcgaatctccttctggcactgcaccaggttctaccagcgaatctccgtctggcactgcaccaggtacctctacccctgaaagcggttccgcttctccaggttctactagcgaatctccttctggtaccgctccaggtacttctacccctgaaagcggctccgcttctccaggttccactagctctaccgctgaatctccgggtccaggttctactagctctactgcagaatctcctggcccaggtacctctactccggaaagcggctctgcatctccaggtacttctacccctgaaagcggttctgcatctccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggttctaccagcgaatccccgtctggtactgctccaggttctaccagcgaatctccttctggtactgcaccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctactagcgaatctccttctggcactgcaccaggttctaccagcgaatctccgtctggcactgcaccaggtacctctacccctgaaagcggttccgcttctccaggtacttctccgagcggtgaatcttctaccgcaccaggttctactagctctaccgctgaatctccgggcccaggtacttctccgagcggtgaatcttctactgctccaggttccactagctctactgctgaatctcctggcccaggtacttctactccggaaagcggttccgcttctccaggttctactagcgaatctccgtctggcaccgcaccaggttctactagctctactgcagaatctcctggcccaggtacctctactccggaaagcggctctgcatctccaggtacttctacccctgaaagcggttctgcatctccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 745 - protein, 962 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 746 - DNA, 2889 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 747 - protein, 1173 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSSGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 748 - DNA, 3522 bp, Artificial Sequence
  Description of Artificial Sequence: Synthetic polynucleotide
ggttcctctgaaagcggttcttccgaaggtggtccaggttcctctgaaagcggttcttctgagggtggtccaggtgaatctccgggtggctccagcggttccgagtcaggttctggtggcgaaccttccgagtctggtagctcaggtgaatctccgggtggttctagcggttccgagtcaggtgaatctccgggtggttccagcggttctgagtcaggttcctccgaaagcggttcttctgagggcggtccaggttcctccgaaagcggttcttccgagggcggtccaggttcttctgaaagcggttcttccgagggcggtccaggtgaatctcctggtggttccagcggttccgagtcaggtgaatctccaggtggctctagcggttccgagtcaggtgaatctcctggtggttctagcggttctgaatcaggttcctccgaaagcggttcttctgagggcggtccaggttcctccgaaagcggttcttccgagggcggtccaggttcttctgaaagcggttcttccgagggcggtccaggttcctctgaaagcggttcttctgagggcggtccaggttcttccgaaagcggttcttccgagggcggtccaggttcttccgaaagcggttcttctgaaggcggtccaggttctggtggcgaaccgtccgagtctggtagctcaggtgaatctccgggtggctctagcggttccgagtcaggtgaatctcctggtggttccagcggttccgagtcaggttccggtggcgaaccgtccgaatctggtagctcaggtagcgaaggttcttctggtccaggcgaatcttcaggttcctctgaaagcggttcttctgagggcggtccaggttccggtggcgaaccgtccgaatctggtagctcaggtagcgaaggttcttctggtccaggcgaatcttcaggttcctctgaaagcggttcttctgagggcggtccaggttccggtggcgaaccttccgaatctggtagctcaggtgaatctccgggtggttctagcggttctgagtcaggttctggtggtgaaccttccgagtctggtagctcaggttctggtggcgaaccatccgagtctggtagctcaggttcttccgaaagcggttcttccgaaggcggtccaggttctggtggtgaaccgtccgaatctggtagctcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggtgaatcttcaggtagcgaaggttcttctggtcctggtgaatcctcaggttccggtggcgaaccatctgaatctggtagctcaggttcctctgaaagcggttcttccgaaggtggtccaggttcctctgaaagcggttcttctgagggtggtccaggtgaatctccgggtggctccagcggttccgagtcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggttcctctgaaagcggttcttctgagggcggtccaggttctggtggcgaaccatctgaatctggtagctcaggtagcgaaggttcttccggtccgggtgaatcttcaggtagcgaaggttcttccggtccaggtgaatcttcaggtagcgaaggttcttctggtcctggtgaatcctcaggttccggtggcgaaccatctgaatctggtagctcaggttctggtggcgaaccatccgaatctggtagctcaggtgaatctccgggtggctccagcggttctgaatcaggtgaatctcctggtggctccagcggttctgagtcaggttctggtggcgaaccatccgaatctggtagctcaggtagcgaaggttcttctggtcctggcgaatcttcaggtgaatctccaggtggctctagcggttccgaatcaggttcctctgaaagcggttcttctgagggcggtccaggttcttccgaaagcggttcttccgagggcggtccaggttcttccgaaagcggttcttctgaaggcggtccaggttctggtggcgaaccgtccgaatctggtagctcaggttcctccgaaagcggttcttctgaaggtggtccaggtgaatctccaggtggttctagcggttctgaatcaggttctggtggcgaaccgtccgaatctggtagctcaggttcctccgaaagcggttcttctgaaggtggtccaggtgaatctccaggtggttctagcggttctgaatcaggttctggtggcgaaccgtccgaatctggtagctcaggtgaatctcctggtggttccagcggttccgagtcaggttctggtggcgaaccttccgaatctggtagctcaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 749 - protein, 1201 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 750 - DNA, 3606 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 751 - protein, 1212 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 752 - DNA, 3639 bp, Artificial Sequence
  Description of Artificial Sequence: Synthetic polynucleotide
  modified_base (1287)..(1298): a, c, t, g, unknown or other
  modified_base (1330)..(1337): a, c, t, g, unknown or other
ggttctaccagcgaatctccttctggcaccgctccaggtacctctcctagcggcgaatcttctaccgctccaggttctactagcgaatctccttctggcactgcaccaggttctactagcgaatccccgtctggtactgctccaggtacttctactcctgaaagcggttccgcttctccaggtacctctactccggaaagcggttctgcatctccaggttctaccagcgaatctccttctggcaccgctccaggttctactagcgaatccccgtctggtaccgcaccaggtacttctcctagcggcgaatcttctaccgcaccaggttctactagcgaatctccgtctggcactgctccaggtacttctcctagcggtgaatcttctaccgctccaggtacttcccctagcggcgaatcttctaccgctccaggttctactagctctactgcagaatctccgggcccaggtacctctcctagcggtgaatcttctaccgctccaggtacttctccgagcggtgaatcttctaccgctccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctaccagctctaccgcagaatctcctggtccaggtacctctactccggaaagcggctctgcatctccaggttctactagcgaatctccttctggcactgcaccaggtacttctccgagcggtgaatcttctaccgcaccaggttctactagctctaccgctgaatctccgggcccaggtacttctccgagcggtgaatcttctactgctccaggtacctctactcctgaaagcggttctgcatctccaggttccactagctctaccgcagaatctccgggcccaggttctactagctctactgctgaatctcctggcccaggttctactagctctactgctgaatctccgggtccaggttctaccagctctactgctgaatctcctggtccaggtacctccccgagcggtgaatcttctactgcaccaggttctactagcgaatctccttctggcactgcaccaggttctaccagcgaatctccgtctggcactgcaccaggtacctctacccctgaaagcggtccnnnnnnnnnnnntgcaagcgcaagcggcgcgccaagcacgggannnnnnnntagcgaatctccttctggtaccgctccaggttctaccagcgaatccccgtctggtactgctccaggttctaccagcgaatctccttctggtactgcaccaggttctactagcgaatctccttctggtaccgctccaggttctaccagcgaatccccgtctggtactgctccaggttctaccagcgaatctccttctggtactgcaccaggtacttctactccggaaagcggttccgcatctccaggtacttctcctagcggtgaatcttctactgctccaggtacctctcctagcggcgaatcttctactgctccaggttctaccagctctactgctgaatctccgggtccaggtacttccccgagcggtgaatcttctactgcaccaggtacttctactccggaaagcggttccgcttctccaggttctaccagcgaatctccttctggcaccgctccaggttctactagcgaatccccgtctggtaccgcaccaggtacttctcctagcggcgaatcttctaccgcaccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggtacttctacccctgaaagcggctccgcttctccaggttccactagctctaccgctgaatctccgggtccaggttctaccagcgaatctccttctggcaccgctccaggttctactagcgaatccccgtctggtaccgcaccaggtacttctcctagcggcgaatcttctaccgcaccaggttctaccagctctactgctgaatctccgggtccaggtacttccccgagcggtgaatcttctactgcaccaggtacttctactccggaaagcggttccgcttctccaggtacctcccctagcggcgaatcttctactgctccaggtacctctcctagcggcgaatcttctaccgctccaggtacctcccctagcggtgaatcttctaccgcaccaggttctactagctctactgctgaatctccgggtccaggttctaccagctctactgctgaatctcctggtccaggtacctccccgagcggtgaatcttctactgcaccaggttctagcccttctgcttccaccggtaccggcccaggtagctctactccgtctggtgcaactggctctccaggtagctctactccgtctggtgcaaccggctccccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 753 - protein, 1201 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 754 - DNA, 3606 bp, Artificial Sequence
  Description of Artificial Sequence: Synthetic polynucleotide
ggtgcttccccgggcaccagctctactggttctccaggttctagcccgtctgcttctactggtactggtccaggttctagcccttctgcttccactggtactggtccaggtaccccgggtagcggtaccgcttcttcttctccaggtagctctactccgtctggtgctaccggctctccaggttctaacccttctgcatccaccggtaccggcccaggtgcttctccgggcaccagctctactggttctccaggtaccccgggcagcggtaccgcatcttcttctccaggtagctctactccttctggtgcaactggttctccaggtactcctggcagcggtaccgcttcttcttctccaggtgcttctcctggtactagctctactggttctccaggtgcttctccgggcactagctctactggttctccaggtaccccgggtagcggtactgcttcttcctctccaggtagctctaccccttctggtgcaaccggctctccaggtgcttctccgggcaccagctctaccggttctccaggtaccccgggtagcggtaccgcttcttcttctccaggtagctctactccgtctggtgctaccggctctccaggttctaacccttctgcatccaccggtaccggcccaggttctagcccttctgcttccaccggtactggcccaggtagctctaccccttctggtgctaccggctccccaggtagctctactccttctggtgcaactggctctccaggtgcatctccgggcactagctctactggttctccaggtgcatcccctggcactagctctactggttctccaggtgcttctcctggtaccagctctactggttctccaggtactcctggcagcggtaccgcttcttcttctccaggtgcttctcctggtactagctctactggttctccaggtgcttctccgggcactagctctactggttctccaggtgcttccccgggcactagctctaccggttctccaggttctagcccttctgcatctactggtactggcccaggtactccgggcagcggtactgcttcttcctctccaggtgcatctccgggcactagctctactggttctccaggtgcatcccctggcactagctctactggttctccaggtgcttctcctggtaccagctctactggttctccaggtagctctactccgtctggtgcaaccggttccccaggtagctctactccttctggtgctactggctccccaggtgcatcccctggcaccagctctaccggttctccaggtaccccgggcagcggtaccgcatcttcctctccaggtagctctaccccgtctggtgctaccggttccccaggtagctctaccccgtctggtgcaaccggctccccaggtagctctactccgtctggtgcaaccggctccccaggttctagcccgtctgcttccactggtactggcccaggtgcttccccgggcaccagctctactggttctccaggtgcatccccgggtaccagctctaccggttctccaggtactcctggcagcggtactgcatcttcctctccaggtgcttctccgggcaccagctctactggttctccaggtgcatctccgggcactagctctactggttctccaggtgcatcccctggcactagctctactggttctccaggtgcttctcctggtaccagctctactggttctccaggtacccctggtagcggtactgcttcttcctctccaggtagctctactccgtctggtgctaccggttctccaggtaccccgggtagcggtaccgcatcttcttctccaggtagctctaccccgtctggtgctactggttctccaggtactccgggcagcggtactgcttcttcctctccaggtagctctaccccttctggtgctactggctctccaggtagctctaccccgtctggtgctactggctccccaggttctagcccttctgcatccaccggtaccggtccaggttctagcccgtctgcatctactggtactggtccaggtgcatccccgggcactagctctaccggttctccaggtactcctggtagcggtactgcttcttcttctccaggtagctctactccttctggtgctactggttctccaggttctagcccttctgcatccaccggtaccggcccaggttctagcccgtctgcttctaccggtactggtccaggtgcttctccgggtactagctctactggttctccaggtgcatctcctggtactagctctactggttctccaggtagctctactccgtctggtgcaaccggctctccaggttctagcccttctgcatctaccggtactggtccaggtgcatcccctggtaccagctctaccggttctccaggttctagcccttctgcttctaccggtaccggtccaggtacccctggcagcggtaccgcatcttcctctccaggtagctctactccgtctggtgcaaccggttccccaggtagctctactccttctggtgctactggctccccaggtgcatcccctggcaccagctctaccggttctccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 755 - protein, 1212 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 756 - DNA, 3639 bp, Artificial Sequence
  Description of Artificial Sequence: Synthetic polynucleotide
ggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 757 - protein, 1251 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGTSESATPESGPGTSTEPSEGSAPGTSTEPSEGSAPGTSESATPESGPGTSTEPSEGSAPGTSTEPSEGSAPGTSESATPESGPGTSTEPSEGSAPGTSTEPSEGSAPGTSTEPSEGSAPGSPAGSPTSTEEGTSTEPSEGSAPG

SEQ ID NO: 758 - DNA, 3753 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 759 - protein, 1261 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 760 - DNA, 3756 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtgttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttcggaggtacttctgaaagcgctactccggagtccggtccaggtacctctaccgaaccgtccgaaggcagcgctccaggtacttctactgaaccttctgagggtagcgctccaggtacttctgaaagcgctactccggagtccggtccaggtacctctaccgaaccgtccgaaggcagcgctccaggtacttctactgaaccttctgagggtagcgctccaggtacctctgaaagcgctactccggagtctggcccaggtacctctactgaaccgtctgagggtagcgctccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggttaa

SEQ ID NO: 761 - protein, 1655 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 762 - DNA, 4968 bp, Artificial Sequence
  Description of Artificial Sequence: Synthetic polynucleotide
ggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtccagaaccaacggggccggccccaagcggaggtagcgaaccggcaacctccggctctgaaaccccaggtacctctgaaagcgctactcctgaatccggcccaggtagcccggcaggttctccgacttccactgaggaaggtacttctgaaagcgctactcctgagtccggcccaggtagcccggctggctctccgacttccaccgaggaaggtagcccggctggctctccaacttctactgaagaaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggttctaccagcgaatctccttctggcaccgctccaggttctactagcgaatccccgtctggtaccgcaccaggtacttctcctagcggcgaatcttctaccgcaccaggtacttctaccgaaccttccgagggcagcgcaccaggtacttctgaaagcgctacccctgagtccggcccaggtacttctgaaagcgctactcctgaatccggtccaggtagcgaaccggcaacctctggctctgaaaccccaggtacctctgaaagcgctactccggaatctggtccaggtacttctgaaagcgctactccggaatccggtccaggtacctctactgaaccttctgagggcagcgctccaggtacttctgaaagcgctaccccggagtccggtccaggtacttctactgaaccgtccgaaggtagcgcaccaggtacctcccctagcggcgaatcttctactgctccaggtacctctcctagcggcgaatcttctaccgctccaggtacctcccctagcggtgaatcttctaccgcaccaggtacttctaccgaaccgtccgagggtagcgcaccaggtagcccagcaggttctcctacctccaccgaggaaggtacttctaccgaaccgtccgagggtagcgcaccaggttctagcccttctgcttccaccggtaccggcccaggtagctctactccgtctggtgcaactggctctccaggtagctctactccgtctggtgcaaccggctccccaggtagctctaccccgtctggtgctaccggctctccaggtagctctaccccgtctggtgcaaccggctccccaggtgcatccccgggtactagctctaccggttctccaggtgcaagcgcaagcggcgcgccaagcacgggaggtacttctccgagcggtgaatcttctaccgcaccaggttctactagctctaccgctgaatctccgggcccaggtacttctccgagcggtgaatcttctactgctccaggtacctctgaaagcgctactccggagtctggcccaggtacctctactgaaccgtctgagggtagcgctccaggtacttctactgaaccgtccgaaggtagcgcaccaggttctagcccttctgcatctactggtactggcccaggtagctctactccttctggtgctaccggctctccaggtgcttctccgggtactagctctaccggttctccaggtacttctactccggaaagcggttccgcatctccaggtacttctcctagcggtgaatcttctactgctccaggtacctctcctagcggcgaatcttctactgctccaggtacttctgaaagcgcaacccctgaatccggtccaggtagcgaaccggctacttctggctctgagactccaggtacttctaccgaaccgtccgaaggtagcgcaccaggttctaccagcgaatccccttctggtactgctccaggttctaccagcgaatccccttctggcaccgcaccaggtacttctacccctgaaagcggctccgcttctccaggtagcccggcaggctctccgacctctactgaggaaggtacttctgaaagcgcaaccccggagtccggcccaggtacctctaccgaaccgtctgagggcagcgcaccaggtagccctgctggctctccaacctccaccgaagaaggtacctctgaaagcgcaacccctgaatccggcccaggtagcgaaccggcaacctccggttctgaaaccccaggtagctctaccccgtctggtgctaccggttccccaggtgcttctcctggtactagctctaccggttctccaggtagctctaccccgtctggtgctactggctctccaggttctactagcgaatccccgtctggtactgctccaggtacttcccctagcggtgaatcttctactgctccaggttctaccagctctaccgcagaatctccgggtccaggtagctctaccccttctggtgcaaccggctctccaggtgcatccccgggtaccagctctaccggttctccaggtactccgggtagcggtaccgcttcttcctctccaggtagccctgctggctctccgacttctactgaggaaggtagcccggctggttctccgacttctactgaggaaggtacttctaccgaaccttccgaaggtagcgctccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 763 - protein, 530 aa, Artificial Sequence
  Description of Artificial Sequence: Synthetic polypeptide
MAEPAGSPTSTEEGTPGSGTASSSPGSSTPSGATGSPGASPGTSSTGSPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 764 - DNA, 1593 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 765 - protein, 530 aa, Artificial Sequence
  Description of Artificial Sequence: Synthetic polypeptide
MAEPAGSPTSTEEGASPGTSSTGSPGSSTPSGATGSPGSSTPSGATGSPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 766 - DNA, 1593 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 767 - protein, 625 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 768 - DNA, 1878 bp, Artificial Sequence
  Description of Artificial Sequence: Synthetic polynucleotide
ggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 769 - protein, 769 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 770 - DNA, 2310 bp, Artificial Sequence
  Description of Artificial Sequence: Synthetic polynucleotide
ggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 771 - protein, 625 aa, Artificial Sequence
  Description of Artificial Sequence: Synthetic polypeptide
GTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 772 - DNA, 1878 bp, Artificial Sequence
  Description of Artificial Sequence: Synthetic polynucleotide
ggtacttctactccggaaagcggttccgcatctccaggtacttctcctagcggtgaatcttctactgctccaggtacctctcctagcggcgaatcttctactgctccaggttctaccagctctaccgctgaatctcctggcccaggttctaccagcgaatccccgtctggcaccgcaccaggttctactagctctaccgcagaatctccgggtccaggtacttcccctagcggtgaatcttctactgctccaggtacctctactccggaaagcggctccgcatctccaggttctactagctctactgctgaatctcctggtccaggtacctcccctagcggcgaatcttctactgctccaggtacctctcctagcggcgaatcttctaccgctccaggtacctcccctagcggtgaatcttctaccgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 773 - protein, 1057 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 774 - DNA, 3174 bp, Artificial Sequence
  Description of Artificial Sequence: Synthetic polynucleotide
ggttcctctgaaagcggttcttccgaaggtggtccaggttcctctgaaagcggttcttctgagggtggtccaggtgaatctccgggtggctccagcggttccgagtcaggttctggtggcgaaccttccgagtctggtagctcaggtgaatctccgggtggttctagcggttccgagtcaggtgaatctccgggtggttccagcggttctgagtcaggttcctccgaaagcggttcttctgagggcggtccaggttcctccgaaagcggttcttccgagggcggtccaggttcttctgaaagcggttcttccgagggcggtccaggtgaatctcctggtggttccagcggttccgagtcaggtgaatctccaggtggctctagcggttccgagtcaggtgaatctcctggtggttctagcggttctgaatcaggttcctccgaaagcggttcttctgagggcggtccaggttcctccgaaagcggttcttccgagggcggtccaggttcttctgaaagcggttcttccgagggcggtccaggttcctctgaaagcggttcttctgagggcggtccaggttcttccgaaagcggttcttccgagggcggtccaggttcttccgaaagcggttcttctgaaggcggtccaggttctggtggcgaaccgtccgagtctggtagctcaggtgaatctccgggtggctctagcggttccgagtcaggtgaatctcctggtggttccagcggttccgagtcaggttccggtggcgaaccgtccgaatctggtagctcaggtagcgaaggttcttctggtccaggcgaatcttcaggttcctctgaaagcggttcttctgagggcggtccaggttccggtggcgaaccgtccgaatctggtagctcaggtagcgaaggttcttctggtccaggcgaatcttcaggttcctctgaaagcggttcttctgagggcggtccaggttccggtggcgaaccttccgaatctggtagctcaggtgaatctccgggtggttctagcggttctgagtcaggttctggtggtgaaccttccgagtctggtagctcaggttctggtggcgaaccatccgagtctggtagctcaggttcttccgaaagcggttcttccgaaggcggtccaggttctggtggtgaaccgtccgaatctggtagctcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggtgaatcttcaggtagcgaaggttcttctggtcctggtgaatcctcaggttccggtggcgaaccatctgaatctggtagctcaggttcctctgaaagcggttcttccgaaggtggtccaggttcctctgaaagcggttcttctgagggtggtccaggtgaatctccgggtggctccagcggttccgagtcaggttctggtggcgaaccatccgaatctggtagctcaggtagcgaaggttcttctggtcctggcgaatcttcaggtgaatctccaggtggctctagcggttccgaatcaggtagcgaaggttcttccggtcctggtgagtcttcaggtgaatctccaggtggctctagcggttccgagtcaggtagcgaaggttcttctggtcctggcgagtcctcaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 775 - protein, 1057 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 776 - DNA, 3174 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 777 - protein, 1057 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 778 - DNA, 3174 bp, Artificial Sequence
  Description of Artificial Sequence: Synthetic polynucleotide
ggttctactagctctaccgctgaatctcctggcccaggttccactagctctaccgcagaatctccgggcccaggttctactagcgaatccccttctggtaccgctccaggttctactagctctaccgctgaatctccgggtccaggttctaccagctctactgcagaatctcctggcccaggtacttctactccggaaagcggttccgcttctccaggttctaccagcgaatctccttctggcaccgctccaggtacctctcctagcggcgaatcttctaccgctccaggttctactagcgaatctccttctggcactgcaccaggttctaccagcgaatctccttctggcaccgctccaggtacctctcctagcggcgaatcttctaccgctccaggttctactagcgaatctccttctggcactgcaccaggttctaccagcgaatctccttctggcaccgctccaggtacctctcctagcggcgaatcttctaccgctccaggttctactagcgaatctccttctggcactgcaccaggttctactagcgaatctccttctggcactgcaccaggttctaccagcgaatctccgtctggcactgcaccaggtacctctacccctgaaagcggttccgcttctccaggttctactagcgaatctccttctggtaccgctccaggtacttctacccctgaaagcggctccgcttctccaggttccactagctctaccgctgaatctccgggtccaggttctactagctctactgcagaatctcctggcccaggtacctctactccggaaagcggctctgcatctccaggtacttctacccctgaaagcggttctgcatctccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggttctaccagcgaatccccgtctggtactgctccaggttctaccagcgaatctccttctggtactgcaccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctactagcgaatctccttctggcactgcaccaggttctaccagcgaatctccgtctggcactgcaccaggtacctctacccctgaaagcggttccgcttctccaggtacttctccgagcggtgaatcttctaccgcaccaggttctactagctctaccgctgaatctccgggcccaggtacttctccgagcggtgaatcttctactgctccaggttccactagctctactgctgaatctcctggcccaggtacttctactccggaaagcggttccgcttctccaggttctactagcgaatctccgtctggcaccgcaccaggttctactagctctactgcagaatctcctggcccaggtacctctactccggaaagcggctctgcatctccaggtacttctacccctgaaagcggttctgcatctccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 779 - protein, 1106 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 780 - DNA, 3321 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 781 - protein, 1317 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSSGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 782 - DNA, 3954 bp, Artificial Sequence
  Description of Artificial Sequence: Synthetic polynucleotide
ggttcctctgaaagcggttcttccgaaggtggtccaggttcctctgaaagcggttcttctgagggtggtccaggtgaatctccgggtggctccagcggttccgagtcaggttctggtggcgaaccttccgagtctggtagctcaggtgaatctccgggtggttctagcggttccgagtcaggtgaatctccgggtggttccagcggttctgagtcaggttcctccgaaagcggttcttctgagggcggtccaggttcctccgaaagcggttcttccgagggcggtccaggttcttctgaaagcggttcttccgagggcggtccaggtgaatctcctggtggttccagcggttccgagtcaggtgaatctccaggtggctctagcggttccgagtcaggtgaatctcctggtggttctagcggttctgaatcaggttcctccgaaagcggttcttctgagggcggtccaggttcctccgaaagcggttcttccgagggcggtccaggttcttctgaaagcggttcttccgagggcggtccaggttcctctgaaagcggttcttctgagggcggtccaggttcttccgaaagcggttcttccgagggcggtccaggttcttccgaaagcggttcttctgaaggcggtccaggttctggtggcgaaccgtccgagtctggtagctcaggtgaatctccgggtggctctagcggttccgagtcaggtgaatctcctggtggttccagcggttccgagtcaggttccggtggcgaaccgtccgaatctggtagctcaggtagcgaaggttcttctggtccaggcgaatcttcaggttcctctgaaagcggttcttctgagggcggtccaggttccggtggcgaaccgtccgaatctggtagctcaggtagcgaaggttcttctggtccaggcgaatcttcaggttcctctgaaagcggttcttctgagggcggtccaggttccggtggcgaaccttccgaatctggtagctcaggtgaatctccgggtggttctagcggttctgagtcaggttctggtggtgaaccttccgagtctggtagctcaggttctggtggcgaaccatccgagtctggtagctcaggttcttccgaaagcggttcttccgaaggcggtccaggttctggtggtgaaccgtccgaatctggtagctcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggtgaatcttcaggtagcgaaggttcttctggtcctggtgaatcctcaggttccggtggcgaaccatctgaatctggtagctcaggttcctctgaaagcggttcttccgaaggtggtccaggttcctctgaaagcggttcttctgagggtggtccaggtgaatctccgggtggctccagcggttccgagtcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggttcctctgaaagcggttcttctgagggcggtccaggttctggtggcgaaccatctgaatctggtagctcaggtagcgaaggttcttccggtccgggtgaatcttcaggtagcgaaggttcttccggtccaggtgaatcttcaggtagcgaaggttcttctggtcctggtgaatcctcaggttccggtggcgaaccatctgaatctggtagctcaggttctggtggcgaaccatccgaatctggtagctcaggtgaatctccgggtggctccagcggttctgaatcaggtgaatctcctggtggctccagcggttctgagtcaggttctggtggcgaaccatccgaatctggtagctcaggtagcgaaggttcttctggtcctggcgaatcttcaggtgaatctccaggtggctctagcggttccgaatcaggttcctctgaaagcggttcttctgagggcggtccaggttcttccgaaagcggttcttccgagggcggtccaggttcttccgaaagcggttcttctgaaggcggtccaggttctggtggcgaaccgtccgaatctggtagctcaggttcctccgaaagcggttcttctgaaggtggtccaggtgaatctccaggtggttctagcggttctgaatcaggttctggtggcgaaccgtccgaatctggtagctcaggttcctccgaaagcggttcttctgaaggtggtccaggtgaatctccaggtggttctagcggttctgaatcaggttctggtggcgaaccgtccgaatctggtagctcaggtgaatctcctggtggttccagcggttccgagtcaggttctggtggcgaaccttccgaatctggtagctcaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 783 - protein, 1345 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 784 - DNA, 4038 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 785 - protein, 1356 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 786 - DNA, 4071 bp, Artificial Sequence
  Description of Artificial Sequence: Synthetic polynucleotide
  modified_base (1287)..(1298): a, c, t, g, unknown or other
  modified_base (1330)..(1337): a, c, t, g, unknown or other
ggttctaccagcgaatctccttctggcaccgctccaggtacctctcctagcggcgaatcttctaccgctccaggttctactagcgaatctccttctggcactgcaccaggttctactagcgaatccccgtctggtactgctccaggtacttctactcctgaaagcggttccgcttctccaggtacctctactccggaaagcggttctgcatctccaggttctaccagcgaatctccttctggcaccgctccaggttctactagcgaatccccgtctggtaccgcaccaggtacttctcctagcggcgaatcttctaccgcaccaggttctactagcgaatctccgtctggcactgctccaggtacttctcctagcggtgaatcttctaccgctccaggtacttcccctagcggcgaatcttctaccgctccaggttctactagctctactgcagaatctccgggcccaggtacctctcctagcggtgaatcttctaccgctccaggtacttctccgagcggtgaatcttctaccgctccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctaccagctctaccgcagaatctcctggtccaggtacctctactccggaaagcggctctgcatctccaggttctactagcgaatctccttctggcactgcaccaggtacttctccgagcggtgaatcttctaccgcaccaggttctactagctctaccgctgaatctccgggcccaggtacttctccgagcggtgaatcttctactgctccaggtacctctactcctgaaagcggttctgcatctccaggttccactagctctaccgcagaatctccgggcccaggttctactagctctactgctgaatctcctggcccaggttctactagctctactgctgaatctccgggtccaggttctaccagctctactgctgaatctcctggtccaggtacctccccgagcggtgaatcttctactgcaccaggttctactagcgaatctccttctggcactgcaccaggttctaccagcgaatctccgtctggcactgcaccaggtacctctacccctgaaagcggtccnnnnnnnnnnnntgcaagcgcaagcggcgcgccaagcacgggannnnnnnntagcgaatctccttctggtaccgctccaggttctaccagcgaatccccgtctggtactgctccaggttctaccagcgaatctccttctggtactgcaccaggttctactagcgaatctccttctggtaccgctccaggttctaccagcgaatccccgtctggtactgctccaggttctaccagcgaatctccttctggtactgcaccaggtacttctactccggaaagcggttccgcatctccaggtacttctcctagcggtgaatcttctactgctccaggtacctctcctagcggcgaatcttctactgctccaggttctaccagctctactgctgaatctccgggtccaggtacttccccgagcggtgaatcttctactgcaccaggtacttctactccggaaagcggttccgcttctccaggttctaccagcgaatctccttctggcaccgctccaggttctactagcgaatccccgtctggtaccgcaccaggtacttctcctagcggcgaatcttctaccgcaccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggtacttctacccctgaaagcggctccgcttctccaggttccactagctctaccgctgaatctccgggtccaggttctaccagcgaatctccttctggcaccgctccaggttctactagcgaatccccgtctggtaccgcaccaggtacttctcctagcggcgaatcttctaccgcaccaggttctaccagctctactgctgaatctccgggtccaggtacttccccgagcggtgaatcttctactgcaccaggtacttctactccggaaagcggttccgcttctccaggtacctcccctagcggcgaatcttctactgctccaggtacctctcctagcggcgaatcttctaccgctccaggtacctcccctagcggtgaatcttctaccgcaccaggttctactagctctactgctgaatctccgggtccaggttctaccagctctactgctgaatctcctggtccaggtacctccccgagcggtgaatcttctactgcaccaggttctagcccttctgcttccaccggtaccggcccaggtagctctactccgtctggtgcaactggctctccaggtagctctactccgtctggtgcaaccggctccccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 787 - protein, 1345 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 788 - DNA, 4038 bp, Artificial Sequence
  Description of Artificial Sequence: Synthetic polynucleotide
ggtgcttccccgggcaccagctctactggttctccaggttctagcccgtctgcttctactggtactggtccaggttctagcccttctgcttccactggtactggtccaggtaccccgggtagcggtaccgcttcttcttctccaggtagctctactccgtctggtgctaccggctctccaggttctaacccttctgcatccaccggtaccggcccaggtgcttctccgggcaccagctctactggttctccaggtaccccgggcagcggtaccgcatcttcttctccaggtagctctactccttctggtgcaactggttctccaggtactcctggcagcggtaccgcttcttcttctccaggtgcttctcctggtactagctctactggttctccaggtgcttctccgggcactagctctactggttctccaggtaccccgggtagcggtactgcttcttcctctccaggtagctctaccccttctggtgcaaccggctctccaggtgcttctccgggcaccagctctaccggttctccaggtaccccgggtagcggtaccgcttcttcttctccaggtagctctactccgtctggtgctaccggctctccaggttctaacccttctgcatccaccggtaccggcccaggttctagcccttctgcttccaccggtactggcccaggtagctctaccccttctggtgctaccggctccccaggtagctctactccttctggtgcaactggctctccaggtgcatctccgggcactagctctactggttctccaggtgcatcccctggcactagctctactggttctccaggtgcttctcctggtaccagctctactggttctccaggtactcctggcagcggtaccgcttcttcttctccaggtgcttctcctggtactagctctactggttctccaggtgcttctccgggcactagctctactggttctccaggtgcttccccgggcactagctctaccggttctccaggttctagcccttctgcatctactggtactggcccaggtactccgggcagcggtactgcttcttcctctccaggtgcatctccgggcactagctctactggttctccaggtgcatcccctggcactagctctactggttctccaggtgcttctcctggtaccagctctactggttctccaggtagctctactccgtctggtgcaaccggttccccaggtagctctactccttctggtgctactggctccccaggtgcatcccctggcaccagctctaccggttctccaggtaccccgggcagcggtaccgcatcttcctctccaggtagctctaccccgtctggtgctaccggttccccaggtagctctaccccgtctggtgcaaccggctccccaggtagctctactccgtctggtgcaaccggctccccaggttctagcccgtctgcttccactggtactggcccaggtgcttccccgggcaccagctctactggttctccaggtgcatccccgggtaccagctctaccggttctccaggtactcctggcagcggtactgcatcttcctctccaggtgcttctccgggcaccagctctactggttctccaggtgcatctccgggcactagctctactggttctccaggtgcatcccctggcactagctctactggttctccaggtgcttctcctggtaccagctctactggttctccaggtacccctggtagcggtactgcttcttcctctccaggtagctctactccgtctggtgctaccggttctccaggtaccccgggtagcggtaccgcatcttcttctccaggtagctctaccccgtctggtgctactggttctccaggtactccgggcagcggtactgcttcttcctctccaggtagctctaccccttctggtgctactggctctccaggtagctctaccccgtctggtgctactggctccccaggttctagcccttctgcatccaccggtaccggtccaggttctagcccgtctgcatctactggtactggtccaggtgcatccccgggcactagctctaccggttctccaggtactcctggtagcggtactgcttcttcttctccaggtagctctactccttctggtgctactggttctccaggttctagcccttctgcatccaccggtaccggcccaggttctagcccgtctgcttctaccggtactggtccaggtgcttctccgggtactagctctactggttctccaggtgcatctcctggtactagctctactggttctccaggtagctctactccgtctggtgcaaccggctctccaggttctagcccttctgcatctaccggtactggtccaggtgcatcccctggtaccagctctaccggttctccaggttctagcccttctgcttctaccggtaccggtccaggtacccctggcagcggtaccgcatcttcctctccaggtagctctactccgtctggtgcaaccggttccccaggtagctctactccttctggtgctactggctccccaggtgcatcccctggcaccagctctaccggttctccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 789 - protein, 1356 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 790 - DNA, 4071 bp, Artificial Sequence
  Description of Artificial Sequence: Synthetic polynucleotide
ggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 791 - protein, 1394 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 792 - DNA, 4185 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 793 - protein, 1405 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 794 - DNA, 4218 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 795 - protein, 1799 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 796 - DNA, 5400 bp, Artificial Sequence
  Description of Artificial Sequence: Synthetic polynucleotide
ggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtccagaaccaacggggccggccccaagcggaggtagcgaaccggcaacctccggctctgaaaccccaggtacctctgaaagcgctactcctgaatccggcccaggtagcccggcaggttctccgacttccactgaggaaggtacttctgaaagcgctactcctgagtccggcccaggtagcccggctggctctccgacttccaccgaggaaggtagcccggctggctctccaacttctactgaagaaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggttctaccagcgaatctccttctggcaccgctccaggttctactagcgaatccccgtctggtaccgcaccaggtacttctcctagcggcgaatcttctaccgcaccaggtacttctaccgaaccttccgagggcagcgcaccaggtacttctgaaagcgctacccctgagtccggcccaggtacttctgaaagcgctactcctgaatccggtccaggtagcgaaccggcaacctctggctctgaaaccccaggtacctctgaaagcgctactccggaatctggtccaggtacttctgaaagcgctactccggaatccggtccaggtacctctactgaaccttctgagggcagcgctccaggtacttctgaaagcgctaccccggagtccggtccaggtacttctactgaaccgtccgaaggtagcgcaccaggtacctcccctagcggcgaatcttctactgctccaggtacctctcctagcggcgaatcttctaccgctccaggtacctcccctagcggtgaatcttctaccgcaccaggtacttctaccgaaccgtccgagggtagcgcaccaggtagcccagcaggttctcctacctccaccgaggaaggtacttctaccgaaccgtccgagggtagcgcaccaggttctagcccttctgcttccaccggtaccggcccaggtagctctactccgtctggtgcaactggctctccaggtagctctactccgtctggtgcaaccggctccccaggtagctctaccccgtctggtgctaccggctctccaggtagctctaccccgtctggtgcaaccggctccccaggtgcatccccgggtactagctctaccggttctccaggtgcaagcgcaagcggcgcgccaagcacgggaggtacttctccgagcggtgaatcttctaccgcaccaggttctactagctctaccgctgaatctccgggcccaggtacttctccgagcggtgaatcttctactgctccaggtacctctgaaagcgctactccggagtctggcccaggtacctctactgaaccgtctgagggtagcgctccaggtacttctactgaaccgtccgaaggtagcgcaccaggttctagcccttctgcatctactggtactggcccaggtagctctactccttctggtgctaccggctctccaggtgcttctccgggtactagctctaccggttctccaggtacttctactccggaaagcggttccgcatctccaggtacttctcctagcggtgaatcttctactgctccaggtacctctcctagcggcgaatcttctactgctccaggtacttctgaaagcgcaacccctgaatccggtccaggtagcgaaccggctacttctggctctgagactccaggtacttctaccgaaccgtccgaaggtagcgcaccaggttctaccagcgaatccccttctggtactgctccaggttctaccagcgaatccccttctggcaccgcaccaggtacttctacccctgaaagcggctccgcttctccaggtagcccggcaggctctccgacctctactgaggaaggtacttctgaaagcgcaaccccggagtccggcccaggtacctctaccgaaccgtctgagggcagcgcaccaggtagccctgctggctctccaacctccaccgaagaaggtacctctgaaagcgcaacccctgaatccggcccaggtagcgaaccggcaacctccggttctgaaaccccaggtagctctaccccgtctggtgctaccggttccccaggtgcttctcctggtactagctctaccggttctccaggtagctctaccccgtctggtgctactggctctccaggttctactagcgaatccccgtctggtactgctccaggtacttcccctagcggtgaatcttctactgctccaggttctaccagctctaccgcagaatctccgggtccaggtagctctaccccttctggtgcaaccggctctccaggtgcatccccgggtaccagctctaccggttctccaggtactccgggtagcggtaccgcttcttcctctccaggtagccctgctggctctccgacttctactgaggaaggtagcccggctggttctccgacttctactgaggaaggtacttctaccgaaccttccgaaggtagcgctccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 797 - protein, 1261 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGLTPRSLLVGGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 798 - DNA, 3786 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtctgaccccgcgcagcctgctggtgggcggcggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 799 - protein, 1261 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGGKLTRVVGGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 800 - DNA, 3786 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggcggcaaactgacccgcgtggtgggcggcggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 801 - protein, 1261 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGGLGPVSGVPGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 802 - DNA, 3786 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggcggcctgggcccggtgagcggcgtgccgggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 803 - protein, 1261 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGAPLGLRLRGGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 804 - DNA, 3786 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtgcgccgctgggcctgcgcctgcgcggcggcggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 805 - protein, 1405 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGLTPRSLLVGGGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 806 - DNA, 4218 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtctgaccccgcgcagcctgctggtgggcggcggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 807 - protein, 1405 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGGKLTRVVGGGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 808 - DNA, 4218 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggcggcaaactgacccgcgtggtgggcggcggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 809 - protein, 1405 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGGLGPVSGVPGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 810 - DNA, 4218 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggcggcctgggcccggtgagcggcgtgccgggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 811 - protein, 1405 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGAPLGLRLRGGGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 812 - DNA, 4218 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtgcgccgctgggcctgcgcctgcgcggcggcggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 813 - protein, 1272 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGLTPRSLLVGGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 814 - DNA, 3819 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtctgaccccgcgcagcctgctggtgggcggcggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 815 - protein, 1272 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGGKLTRVVGGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 816 - DNA, 3819 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggcggcaaactgacccgcgtggtgggcggcggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 817 - protein, 1272 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGGLGPVSGVPGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 818 - DNA, 3819 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggcggcctgggcccggtgagcggcgtgccgggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 819 - protein, 1272 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGAPLGLRLRGGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 820 - DNA, 3819 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtgcgccgctgggcctgcgcctgcgcggcggcggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 821 - protein, 1416 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGLTPRSLLVGGGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 822 - DNA, 4251 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtctgaccccgcgcagcctgctggtgggcggcggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 823 - protein, 1416 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGGKLTRVVGGGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 824 - DNA, 4251 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggcggcaaactgacccgcgtggtgggcggcggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 825 - protein, 1416 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGGLGPVSGVPGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 826 - DNA, 4251 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggcggcctgggcccggtgagcggcgtgccgggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 827 - protein, 1416 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGAPLGLRLRGGGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 828 - DNA, 4251 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtgcgccgctgggcctgcgcctgcgcggcggcggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 829 - protein, 973 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGLTPRSLLVGGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 830 - DNA, 2922 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtctgaccccgcgcagcctgctggtgggcggcggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 831 - protein, 973 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGGKLTRVVGGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 832 - DNA, 2922 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggcggcaaactgacccgcgtggtgggcggcggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 833 - protein, 973 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGGLGPVSGVPGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 834 - DNA, 2922 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggcggcctgggcccggtgagcggcgtgccgggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 835 - protein, 973 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGAPLGLRLRGGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 836 - DNA, 2922 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtgcgccgctgggcctgcgcctgcgcggcggcggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 837 - protein, 1117 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGLTPRSLLVGGGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 838 - DNA, 3354 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtctgaccccgcgcagcctgctggtgggcggcggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 839 - protein, 1117 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGGKLTRVVGGGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 840 - DNA, 3354 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggcggcaaactgacccgcgtggtgggcggcggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 841 - protein, 1117 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGGLGPVSGVPGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 842 - DNA, 3354 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtggcggcctgggcccggtgagcggcgtgccgggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 843 - protein, 1117 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGAPLGLRLRGGGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 844 - DNA, 3354 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggttttccgactattccgctgtctcgtctgtttgataatgctatgctgcgtgcgcaccgtctgcaccagctggcctttgatacttaccaggaatttgaagaagcctacattcctaaagagcagaagtactctttcctgcaaaacccacagacttctctctgcttcagcgaatctattccgacgccttccaatcgcgaggaaactcagcaaaagtccaatctggaactactccgcatttctctgcttctgattcagagctggctagaaccagtgcaatttctgcgttccgtcttcgccaatagcctagtttatggcgcatccgacagcaacgtatacgatctcctgaaagatctcgaggaaggcattcagaccctgatgggtcgtctcgaggatggctctccgcgtactggtcagatcttcaagcagacttactctaaatttgatactaacagccacaatgacgatgcgcttctaaaaaactatggtctgctgtattgttttcgtaaagatatggacaaagttgaaaccttcctgcgtattgttcagtgtcgttccgttgagggcagctgtggtttctaaggtgcgccgctgggcctgcgcctgcgcggcggcggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 845 - DNA, 42 bp, Artificial Sequence
  Description of Artificial Sequence: Synthetic oligonucleotide
  CDS (1)..(39)
  modified_base (7)..(7): a, c, t, or g
  modified_base (9)..(9): a, c, t, or g
  modified_base (10)..(10): a, c, t, or g
  modified_base (12)..(12): a, c, t, or g
  see specification as filed for detailed description of substitutions and preferred embodiments
atggctnvnnvngctggctctccaacctccactgaggaaggt

SEQ ID NO: 846 - protein, 13 aa, Artificial Sequence
  Description of Artificial Sequence: Synthetic peptide
  MOD_RES (3)..(4): Ala, Pro, Ser, Thr, Gly or Glu
  see specification as filed for detailed description of substitutions and preferred embodiments
MAXXAGSPTSTEE

SEQ ID NO: 847 - DNA, 42 bp, Artificial Sequence
  Description of Artificial Sequence: Synthetic oligonucleotide
  CDS (1)..(39)
  modified_base (7)..(7): a, c, t, or g
  modified_base (9)..(9): a, c, t, or g
  modified_base (10)..(10): a, c, t, or g
  modified_base (12)..(12): a, c, t, or g
  see specification as filed for detailed description of substitutions and preferred embodiments
atggctnvnnvngaaagcgcaacccctgagtccggtccaggt

SEQ ID NO: 848 - protein, 13 aa, Artificial Sequence
  Description of Artificial Sequence: Synthetic peptide
  misc_feature (3)..(3): The 'Xaa' at location 3 stands for Ala, Pro, Ser, Thr, Gly, or Glu.
  misc_feature (4)..(4): The 'Xaa' at location 4 stands for Ala, Pro, Ser, Thr, Gly, or Glu.
  see specification as filed for detailed description of substitutions and preferred embodiments
MAXXESATPESGP

SEQ ID NO: 849 - DNA, 42 bp, Artificial Sequence
  Description of Artificial Sequence: Synthetic oligonucleotide
  CDS (1)..(39)
  modified_base (7)..(7): a, c, t, or g
  modified_base (9)..(9): a, c, t, or g
  modified_base (10)..(10): a, c, t, or g
  modified_base (12)..(12): a, c, t, or g
  see specification as filed for detailed description of substitutions and preferred embodiments
atggctnvnnvnactccgtctggtgctaccggttccccaggt

SEQ ID NO: 850 - protein, 13 aa, Artificial Sequence
  Description of Artificial Sequence: Synthetic peptide
  MOD_RES (3)..(4): Ala, Pro, Ser, Thr, Gly or Glu
  see specification as filed for detailed description of substitutions and preferred embodiments
MAXXTPSGATGSP

SEQ ID NO: 851 - protein, 146 aa, Artificial Sequence
  Description of Artificial Sequence: Synthetic polypeptide
GGTSESATPESGPGTSTEPSEGSAPGTSTEPSEGSAPGTSESATPESGPGTSTEPSEGSAPGTSTEPSEGSAPGTSESATPESGPGTSTEPSEGSAPGTSTEPSEGSAPGTSTEPSEGSAPGSPAGSPTSTEEGTSTEPSEGSAPG

SEQ ID NO: 852 - protein, 144 aa, Artificial Sequence
  Description of Artificial Sequence: Synthetic polypeptide
TSESATPESGPGTSTEPSEGSAPGTSTEPSEGSAPGTSESATPESGPGTSTEPSEGSAPGTSTEPSEGSAPGTSESATPESGPGTSTEPSEGSAPGTSTEPSEGSAPGTSTEPSEGSAPGSPAGSPTSTEEGTSTEPSEGSAPG

SEQ ID NO: 853 - protein, 914 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 854 - protein, 145 aa, Artificial Sequence
  Description of Artificial Sequence: Synthetic polypeptide
GTSESATPESGPGTSTEPSEGSAPGTSTEPSEGSAPGTSESATPESGPGTSTEPSEGSAPGTSTEPSEGSAPGTSESATPESGPGTSTEPSEGSAPGTSTEPSEGSAPGTSTEPSEGSAPGSPAGSPTSTEEGTSTEPSEGSAPG

What is claimed is:

1. An isolated fusion protein, comprising a growth hormone (GH) that is at least 90% identical to the amino acid sequence of SEQ ID NO:1, wherein said growth hormone is linked to an extended recombinant polypeptide (XTEN) of at least 100 to about 3000 amino acids residues, wherein the XTEN is characterized in that:
   (a) at least 80% the XTEN sequence consist of non-overlapping sequence motifs, wherein:
      (i) each sequence motif has 12 to 36 amino acid residues, and
      (ii) each motif consist of 4 to 6 types of amino acids selected from glycine (G), alanine (A), serine (S), threonine (T), glutamate (E) and proline (P); and
   (b) the sum of glycine (G), alanine (A), serine (S), threonine (T), glutamate (E) and proline (P) residues constitutes more than 90% of the total amino acid residues of the XTEN sequence; and
   wherein the XTEN comprises an amino acid sequence selected from the group consisting of SEQ ID NOs: 29-58.

2. The isolated fusion protein of claim 1, wherein the growth hormone is a human growth hormone.

3. The isolated fusion protein of claim 1, wherein each motif has 12 to 14 amino acid residues.

4. The isolated fusion protein of claim 1, wherein the sequence of any two contiguous amino acid residues in any one sequence motif does not occur more than twice in the sequence motif.

5. The isolated fusion protein of claim 1, wherein the content of any one amino acid type in the full-length XTEN does not exceed 30%.

6. The isolated fusion protein of claim 1, wherein the sum of glycine (G), alanine (A), serine (S), threonine (T), glutamate (E) and proline (P) residues constitutes at least 95% of the total amino acid residues of the XTEN sequence.

7. The isolated fusion protein of claim 1, wherein the sum of glycine (G), alanine (A), serine (S), threonine (T), glutamate (E) and proline (P) residues at least 99% of the total amino acid residues of the XTEN sequence.

8. The isolated fusion protein of claim 1, wherein the XTEN sequence comprises at least 400 to about 1000 amino acids residues.

9. The isolated fusion protein of claim 1, wherein the XTEN sequence comprises at least 100 to about 200 amino acids residues.

10. The isolated fusion protein of claim 1, wherein the XTEN sequence contains no three contiguous amino acids that are identical unless the amino acids are serine residues.

11. The isolated fusion protein as in any one of claims 1, 8, and 9, further comprising a second XTEN sequence.

12. The fusion protein of claim 1, wherein the fusion protein has a longer terminal half-life when administered to a subject compared to the corresponding GH that lacks the XTEN when administered to a subject at a comparable molar dose.

13. The fusion protein of claim 1, wherein the fusion protein stimulates production of IGF-1 in a subject.

14. The isolated fusion protein of claim 1, wherein the growth hormone peptide and the XTEN is linked via a spacer, wherein the spacer sequence comprises between 1 to about 50 amino acid residues.

15. A pharmaceutical composition comprising the isolated fusion protein of claim 1, and a pharmaceutically acceptable carrier.

16. The isolated protein of claim 1 that is configured according to formula I:

   (I)

wherein independently for each occurrence:
(a) x is either 0 or 1; and
(b) y is either 0 or 1, wherein x+y≥1.

17. The isolated fusion protein of claim 1, wherein the XTEN is fused to the growth hormone on an N- or C-terminus of the growth hormone.

18. The isolated fusion protein as in any one of claims 1, 8, 9, and 17, wherein the XTEN sequence is at least 90% identical to an amino acid sequence selected from the group consisting of SEQ ID NOs:63, 66-67, 69-77, and 851.

19. The isolated fusion protein as in claim 11, wherein the XTEN sequence is at least 90% identical to an amino acid sequence selected from the group consisting of SEQ ID NOs:63, 66-67, 69-77, and 851.

20. The pharmaceutical composition of claim 15 formulated for subcutaneous administration.

21. A method of treating a growth-hormone related condition in a subject, comprising administering to the subject a therapeutically effective amount of the pharmaceutical composition of claim 15 or 20, wherein the growth-hormone related condition is selected from growth-hormone deficiency, Turner's Syndrome, Prader-Willi Syndrome, idiopathic short stature, AIDS wasting, multiple sclerosis, Crohn's disease, ulcerative colitis, and muscular dystrophy.

22. The method of claim 21, wherein the pharmaceutical composition is administered subcutaneously.

23. The method of claim 21, wherein the pharmaceutical composition is administered less frequently in comparison to the corresponding growth hormone that lacks said XTEN or said first and second polypeptide.

24. The method of claim 21, wherein a therapeutic effect is a measured parameter selected from IGF-1 concentrations, IGFBP3 concentration, height velocity, lean body mass, total body fat, trunk fat, response to insulin challenge, rate of division of chondrocytes, chondrocyte numbers, bone density, bone growth, and increase in epiphyseal plate width.

* * * * *